United States Patent
Krieg et al.

(10) Patent No.: US 10,174,315 B2
(45) Date of Patent: Jan. 8, 2019

(54) COMPOSITIONS AND METHODS FOR MODULATING HEMOGLOBIN GENE FAMILY EXPRESSION

(71) Applicants: Translate Bio MA, Inc., Lexington, MA (US); The General Hospital Corporation, Boston, MA (US)

(72) Inventors: Arthur M. Krieg, Cambridge, MA (US); Romesh Subramanian, Framingham, MA (US); James McSwiggen, Arlington, MA (US); Jeannie T. Lee, Boston, MA (US)

(73) Assignees: The General Hospital Corporation, Boston, MA (US); Translate Bio MA, Inc., Lexington, MA (US)

( * ) Notice: Subject to any disclaimer, the term of this patent is extended or adjusted under 35 U.S.C. 154(b) by 31 days.

(21) Appl. No.: 14/401,201

(22) PCT Filed: May 16, 2013

(86) PCT No.: PCT/US2013/041382
§ 371 (c)(1),
(2) Date: Nov. 14, 2014

(87) PCT Pub. No.: WO2013/173599
PCT Pub. Date: Nov. 21, 2013

(65) Prior Publication Data
US 2015/0133528 A1     May 14, 2015

Related U.S. Application Data

(60) Provisional application No. 61/785,956, filed on Mar. 14, 2013, provisional application No. 61/647,901, filed on May 16, 2012.

(51) Int. Cl.
| | |
|---|---|
| C12N 15/113 | (2010.01) |
| A61K 31/7125 | (2006.01) |
| A61K 31/712 | (2006.01) |
| A61K 31/7115 | (2006.01) |
| C07H 21/00 | (2006.01) |
| C07H 21/02 | (2006.01) |
| C07H 21/04 | (2006.01) |
| A61K 31/7088 | (2006.01) |
| A61K 47/28 | (2006.01) |
| A61K 47/64 | (2017.01) |

(52) U.S. Cl.
CPC ........ *C12N 15/113* (2013.01); *A61K 31/7088* (2013.01); *A61K 31/712* (2013.01); *A61K 31/7125* (2013.01); *A61K 47/28* (2013.01); *A61K 47/64* (2017.08); *C07H 21/00* (2013.01); *C07H 21/02* (2013.01); *C07H 21/04* (2013.01); *C12N 2310/11* (2013.01); *C12N 2310/315* (2013.01); *C12N 2310/3231* (2013.01); *C12N 2310/3341* (2013.01); *C12N 2310/341* (2013.01)

(58) Field of Classification Search
None
See application file for complete search history.

(56) References Cited

U.S. PATENT DOCUMENTS

| | | |
|---|---|---|
| 4,725,677 A | 2/1988 | Köster et al. |
| 5,491,133 A | 2/1996 | Walder et al. |
| 5,576,208 A | 11/1996 | Monia et al. |
| 5,623,065 A | 4/1997 | Cook et al. |
| 5,652,355 A | 7/1997 | Metelev et al. |
| 5,661,134 A | 8/1997 | Cook et al. |
| 5,912,332 A | 6/1999 | Agrawal et al. |
| 5,914,396 A | 6/1999 | Cook et al. |
| 5,919,619 A | 7/1999 | Tullis |
| 5,965,722 A | 10/1999 | Ecker et al. |
| 6,015,710 A | 1/2000 | Shay et al. |
| 6,046,307 A | 4/2000 | Shay et al. |
| 6,063,400 A | 5/2000 | Geho et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,395,492 B1 | 5/2002 | Manoharan et al. |
| 6,451,991 B1 | 9/2002 | Martin et al. |
| 6,503,754 B1 | 1/2003 | Zhang et al. |
| 6,531,584 B1 | 3/2003 | Cook et al. |
| 6,608,035 B1 | 8/2003 | Agrawal et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,831,166 B2 | 12/2004 | Manoharan et al. |

(Continued)

FOREIGN PATENT DOCUMENTS

| | | |
|---|---|---|
| CA | 2805791 A1 | 1/2012 |
| EP | 1 044 987 A2 | 10/2000 |

(Continued)

OTHER PUBLICATIONS

Taylor et al. Drug Discovery Today 1999, vol. 4, pp. 562-567.*

(Continued)

*Primary Examiner* — Tracy Vivlemore
(74) *Attorney, Agent, or Firm* — Wolf, Greenfield & Sacks, P.C.

(57) ABSTRACT

Aspects of the invention provide single stranded oligonucleotides for activating or enhancing expression of hemoglobin genes (HBB, HBD, HBE1, HBG1 or HBG2). Further aspects provide compositions and kits comprising single stranded oligonucleotides for activating or enhancing expression of hemoglobin genes. Methods for modulating expression of hemoglobin genes using the single stranded oligonucleotides are also provided. Further aspects of the invention provide methods for selecting a candidate oligonucleotide for activating or enhancing expression of hemoglobin genes.

31 Claims, No Drawings
Specification includes a Sequence Listing.

(56) References Cited

U.S. PATENT DOCUMENTS

| | | |
|---|---|---|
| 6,919,439 B2 | 7/2005 | Manoharan et al. |
| 7,015,315 B1 | 3/2006 | Cook et al. |
| 7,041,816 B2 | 5/2006 | Ravikumar et al. |
| 7,045,609 B2 | 5/2006 | Metelev et al. |
| 7,226,785 B2* | 6/2007 | Kmiec .................. C12N 15/102 435/440 |
| 7,374,927 B2 | 5/2008 | Palma et al. |
| 7,449,297 B2 | 11/2008 | Freije et al. |
| 7,655,785 B1 | 2/2010 | Bentwich |
| 7,683,036 B2 | 3/2010 | Esau et al. |
| 7,687,616 B1 | 3/2010 | Bentwich et al. |
| 7,687,617 B2 | 3/2010 | Thrue et al. |
| 7,709,456 B2 | 5/2010 | Corey et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 8,092,992 B2 | 1/2012 | Kuwabara et al. |
| 8,129,515 B2 | 3/2012 | Esau et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 8,846,639 B2 | 9/2014 | Swayze et al. |
| 9,328,346 B2 | 5/2016 | Lee et al. |
| 9,567,581 B2 | 2/2017 | Lee et al. |
| 9,580,708 B2 | 2/2017 | Uhlmann et al. |
| 9,593,330 B2 | 3/2017 | Collard et al. |
| 2002/0160379 A1 | 10/2002 | Cook et al. |
| 2003/0198983 A1 | 10/2003 | Zhou |
| 2003/0208061 A1* | 11/2003 | Manoharan ............ C07H 21/00 536/25.3 |
| 2003/0219770 A1 | 11/2003 | Eshleman et al. |
| 2003/0228690 A1 | 12/2003 | Baker et al. |
| 2003/0235822 A1* | 12/2003 | Lokhov .................. C07H 19/06 435/6.18 |
| 2004/0002153 A1 | 1/2004 | Monia et al. |
| 2004/0038274 A1 | 2/2004 | Cook et al. |
| 2004/0096848 A1 | 5/2004 | Thrue et al. |
| 2004/0241651 A1 | 12/2004 | Olek et al. |
| 2004/0248840 A1 | 12/2004 | Hansen et al. |
| 2005/0003369 A1 | 1/2005 | Christians et al. |
| 2005/0026160 A1* | 2/2005 | Allerson ................ C07H 21/00 435/6.11 |
| 2005/0054836 A1 | 3/2005 | Krainer et al. |
| 2005/0108783 A1 | 5/2005 | Koike |
| 2005/0130924 A1 | 6/2005 | Monia et al. |
| 2005/0164209 A1 | 7/2005 | Bennett et al. |
| 2005/0176025 A1 | 8/2005 | McSwiggen et al. |
| 2005/0203042 A1 | 9/2005 | Frieden et al. |
| 2005/0233455 A1 | 10/2005 | Damha et al. |
| 2005/0244851 A1 | 11/2005 | Blume et al. |
| 2005/0246794 A1 | 11/2005 | Khvorova et al. |
| 2005/0261218 A1 | 11/2005 | Esau et al. |
| 2005/0272080 A1 | 12/2005 | Palma et al. |
| 2006/0003322 A1 | 1/2006 | Bentwich |
| 2006/0046260 A1 | 3/2006 | Kriksunov et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0042380 A1 | 2/2007 | Bentwich et al. |
| 2007/0111963 A1 | 5/2007 | Corey et al. |
| 2007/0123484 A1 | 5/2007 | Bhat et al. |
| 2007/0191294 A1 | 8/2007 | Elmen et al. |
| 2007/0219244 A1 | 9/2007 | Jenssen et al. |
| 2007/0269815 A1 | 11/2007 | Rivory et al. |
| 2008/0015162 A1 | 1/2008 | Bhanot et al. |
| 2008/0176793 A1 | 7/2008 | Simons et al. |
| 2008/0194463 A1 | 8/2008 | Weller et al. |
| 2008/0249039 A1 | 10/2008 | Elmen et al. |
| 2008/0293655 A1 | 11/2008 | Aygun et al. |
| 2008/0318895 A1 | 12/2008 | Lee et al. |
| 2009/0082297 A1 | 3/2009 | Lioy et al. |
| 2009/0092988 A1 | 4/2009 | Schwartz et al. |
| 2009/0099066 A1 | 4/2009 | Moulton et al. |
| 2009/0099109 A1 | 4/2009 | Shames et al. |
| 2009/0143326 A1 | 6/2009 | Obad et al. |
| 2009/0155910 A1 | 6/2009 | McGonigle |
| 2009/0221685 A1 | 9/2009 | Esau et al. |
| 2009/0258925 A1 | 10/2009 | Wahlestedt |
| 2009/0325868 A1 | 12/2009 | Liu et al. |
| 2009/0326051 A1 | 12/2009 | Corey et al. |
| 2010/0004314 A1* | 1/2010 | Dondero ............ A61K 48/0008 514/44 A |
| 2010/0105760 A1 | 4/2010 | Collard et al. |
| 2010/0111982 A1 | 5/2010 | Zang et al. |
| 2010/0112042 A1 | 5/2010 | Polisky et al. |
| 2010/0124547 A1 | 5/2010 | Bramlage et al. |
| 2010/0143359 A1 | 6/2010 | Ebert et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0247543 A1 | 9/2010 | Maes et al. |
| 2010/0280100 A1 | 11/2010 | Collard et al. |
| 2010/0286141 A1 | 11/2010 | Durden et al. |
| 2010/0286234 A1 | 11/2010 | Elmen et al. |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0110860 A1 | 5/2011 | Corey et al. |
| 2011/0150868 A1 | 6/2011 | Yu et al. |
| 2011/0172292 A1 | 7/2011 | Hansen et al. |
| 2011/0191912 A1 | 8/2011 | Alexandrov |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0294870 A1 | 12/2011 | Collard et al. |
| 2011/0319283 A1 | 12/2011 | Thompson |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0071418 A1 | 3/2012 | Copeland et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149759 A1 | 6/2012 | Collard et al. |
| 2012/0157333 A1 | 6/2012 | Kauppinen et al. |
| 2012/0171170 A1 | 7/2012 | Collard et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colalrd et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |

(56) References Cited

U.S. PATENT DOCUMENTS

| | | |
|---|---|---|
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0143946 A1 | 6/2013 | Collard et al. |
| 2013/0164846 A1 | 6/2013 | Saestrom |
| 2013/0184325 A9 | 7/2013 | Collard et al. |
| 2013/0245099 A1 | 9/2013 | Collard et al. |
| 2013/0261065 A1 | 10/2013 | Collard et al. |
| 2013/0289092 A1 | 10/2013 | Rigo et al. |
| 2014/0142160 A1 | 5/2014 | Lee et al. |
| 2014/0187606 A1 | 7/2014 | Collard et al. |
| 2015/0099791 A1 | 4/2015 | Krieg et al. |
| 2015/0133362 A1 | 5/2015 | Krieg et al. |
| 2015/0133529 A1 | 5/2015 | Krieg et al. |
| 2015/0141320 A1 | 5/2015 | Krieg et al. |
| 2015/0152410 A1 | 6/2015 | Krieg et al. |
| 2015/0159160 A1 | 6/2015 | Krieg et al. |
| 2015/0159161 A1 | 6/2015 | Krieg et al. |
| 2015/0191722 A1 | 7/2015 | Krieg et al. |
| 2015/0218560 A1 | 8/2015 | Krieg et al. |
| 2015/0225717 A1 | 8/2015 | Lee et al. |
| 2017/0037396 A1 | 2/2017 | Lee et al. |

FOREIGN PATENT DOCUMENTS

| | | | | |
|---|---|---|---|---|
| EP | 1 752 536 A1 | 5/2005 | | |
| EP | 1 695 979 A2 | 8/2006 | | |
| EP | 1 957 648 B1 | 11/2006 | | |
| EP | 1752536 A1 | 2/2007 | | |
| EP | 1 967 525 A2 | 9/2008 | | |
| EP | 2 021 472 B1 | 6/2011 | | |
| EP | 2 023 940 B1 | 6/2011 | | |
| EP | 2 431 467 A2 | 3/2012 | | |
| EP | 2 431 467 A3 | 5/2012 | | |
| EP | 2 591 797 A1 | 5/2013 | | |
| JP | 04-320700 | 11/1992 | | |
| JP | 2006-522597 | 10/2006 | | |
| JP | 2008-044958 A | 2/2008 | | |
| JP | 2009-536037 | 10/2009 | | |
| JP | 2010-507579 A | 3/2010 | | |
| JP | 2010-516256 | 5/2010 | | |
| JP | 2015-518714 | 7/2015 | | |
| KR | 10-2011-0050134 A | 5/2011 | | |
| WO | WO 89/05358 A1 | 6/1989 | | |
| WO | WO 93/13121 A1 | 7/1993 | | |
| WO | WO 94/02499 A1 | 2/1994 | | |
| WO | WO 94/17093 A1 | 8/1994 | | |
| WO | WO 2001/007662 A1 | 2/2001 | | |
| WO | WO 01/36627 A2 | 5/2001 | | |
| WO | WO 02/103015 A2 | 12/2002 | | |
| WO | WO 2004011613 A2 * | 2/2004 | ........... | C12N 15/113 |
| WO | WO 2004/099382 A2 | 11/2004 | | |
| WO | WO 2004/113867 A2 | 12/2004 | | |
| WO | WO 2005/042018 A2 | 5/2005 | | |
| WO | WO 2005/044981 A2 | 5/2005 | | |
| WO | WO 2005/061710 A1 | 7/2005 | | |
| WO | WO 2005/089169 A2 | 9/2005 | | |
| WO | WO 2005/094370 A2 | 10/2005 | | |
| WO | WO 2006/063356 A1 | 6/2006 | | |
| WO | WO 2006/130201 A1 | 12/2006 | | |
| WO | WO 2007/031091 A2 | 3/2007 | | |
| WO | WO 2007/086990 A2 | 8/2007 | | |
| WO | WO 2007/086990 A3 | 8/2007 | | |
| WO | WO 2007/115578 A1 | 10/2007 | | |
| WO | WO 2007/133812 A2 | 11/2007 | | |
| WO | WO 2008/024499 A2 | 2/2008 | | |
| WO | WO 2008/025069 A1 | 3/2008 | | |
| WO | WO 2008/029619 A1 | 3/2008 | | |
| WO | WO 2008/061537 A2 | 5/2008 | | |
| WO | WO 2008/083931 A1 | 7/2008 | | |
| WO | WO 2008/103761 A2 | 8/2008 | | |
| WO | WO 2008/103763 A2 | 8/2008 | | |
| WO | WO 2008/113832 A2 | 9/2008 | | |
| WO | WO 2008/141282 A2 | 11/2008 | | |
| WO | WO 2009/043353 A2 | 4/2009 | | |
| WO | WO 2009/046397 A2 | 4/2009 | | |
| WO | WO 2009/061851 A2 | 5/2009 | | |
| WO | WO 2009/090182 A1 | 7/2009 | | |
| WO | WO 2009/124341 A1 | 10/2009 | | |
| WO | WO 2009/134710 A2 | 11/2009 | | |
| WO | WO 2009/149182 A1 | 12/2009 | | |
| WO | WO 2010/000665 A1 | 1/2010 | | |
| WO | WO 2010/014592 A1 | 2/2010 | | |
| WO | WO 2010/065671 A2 | 6/2010 | | |
| WO | WO 2010/065787 A2 | 6/2010 | | |
| WO | WO 2010/083615 A1 | 7/2010 | | |
| WO | WO 2010/093860 A2 | 8/2010 | | |
| WO | WO 2010/093904 A2 | 8/2010 | | |
| WO | WO 2010/102058 A2 | 9/2010 | | |
| WO | WO 2010/107733 A2 | 9/2010 | | |
| WO | WO 2010/129746 A2 | 11/2010 | | |
| WO | WO 2010/129861 A2 | 11/2010 | | |
| WO | WO 2010/135329 A2 | 11/2010 | | |
| WO | WO 2010/135695 A2 | 11/2010 | | |
| WO | WO 2010129799 A2 * | 11/2010 | ........... | A61K 31/713 |
| WO | WO 2010/138806 A2 | 12/2010 | | |
| WO | WO 2010/148050 A2 | 12/2010 | | |
| WO | WO 2010/148065 A2 | 12/2010 | | |
| WO | WO 2010/151671 A2 | 12/2010 | | |
| WO | WO 2010/151674 A2 | 12/2010 | | |
| WO | WO 2011/009624 A1 | 1/2011 | | |
| WO | WO 2011/010706 A1 | 1/2011 | | |
| WO | WO 2011/017516 A2 | 2/2011 | | |
| WO | WO 2011/019815 A2 | 2/2011 | | |
| WO | WO 2011/022606 A2 | 2/2011 | | |
| WO | WO 2011/025862 A2 | 3/2011 | | |
| WO | WO 2011/031482 A2 | 3/2011 | | |
| WO | WO 2011/032109 A1 | 3/2011 | | |
| WO | WO 2011/038205 A2 | 3/2011 | | |
| WO | WO 2011/038210 A2 | 3/2011 | | |
| WO | WO 2011/048125 A1 | 4/2011 | | |
| WO | WO 2011/079261 A2 | 6/2011 | | |
| WO | WO 2011/079263 A2 | 6/2011 | | |
| WO | WO 2011/082409 A2 | 7/2011 | | |
| WO | WO 2011/084455 A2 | 7/2011 | | |
| WO | WO 2011/085066 A2 | 7/2011 | | |
| WO | WO 2011/097388 A1 | 8/2011 | | |
| WO | WO 2011/097582 A2 | 8/2011 | | |
| WO | WO 2011/097641 A1 | 8/2011 | | |
| WO | WO 2011/123745 A2 | 10/2011 | | |
| WO | WO 2011/139387 A1 | 11/2011 | | |
| WO | WO 2011/146674 A2 | 11/2011 | | |
| WO | WO 2011/146675 A2 | 11/2011 | | |
| WO | WO 2011/150005 A2 | 12/2011 | | |
| WO | WO 2011/159836 A2 | 12/2011 | | |
| WO | WO 2011/161460 A2 | 12/2011 | | |
| WO | WO 2011/163499 A2 | 12/2011 | | |
| WO | WO 2012/009347 A2 | 1/2012 | | |
| WO | WO 2012/009402 A2 | 1/2012 | | |
| WO | WO 2012/018881 A2 | 2/2012 | | |
| WO | WO 2012/024478 A2 | 2/2012 | | |
| WO | WO 2012/047956 A2 | 4/2012 | | |
| WO | WO 2012/054723 A2 | 4/2012 | | |
| WO | WO 2012/058268 A2 | 5/2012 | | |
| WO | WO 2012/065143 A2 | 5/2012 | | |
| WO | WO 2012/068340 A2 | 5/2012 | | |
| WO | WO 2012/071238 A2 | 5/2012 | | |
| WO | WO 2012/087983 A1 | 6/2012 | | |
| WO | WO 2012/109476 A2 | 8/2012 | | |
| WO | WO 2012/138487 A2 | 10/2012 | | |
| WO | WO 2012/144220 A1 | 10/2012 | | |
| WO | WO 2012/170771 A1 | 12/2012 | | |
| WO | WO 2013/006619 A1 | 1/2013 | | |
| WO | WO 2013/036403 A1 | 3/2013 | | |
| WO | WO 2013/040429 A1 | 3/2013 | | |
| WO | WO 2013/124807 A2 | 8/2013 | | |
| WO | WO 2013/138374 A2 | 9/2013 | | |

(56) References Cited

FOREIGN PATENT DOCUMENTS

| WO | WO 2013/173598 A1 | 11/2013 |
|---|---|---|
| WO | WO 2013/173599 A1 | 11/2013 |
| WO | WO 2013/173601 A1 | 11/2013 |
| WO | WO 2013/173605 A1 | 11/2013 |
| WO | WO 2013/173608 A1 | 11/2013 |
| WO | WO 2013/173635 A1 | 11/2013 |
| WO | WO 2013/173637 A1 | 11/2013 |
| WO | WO 2013/173638 A1 | 11/2013 |
| WO | WO 2013/173645 A1 | 11/2013 |
| WO | WO 2013/173647 A1 | 11/2013 |
| WO | WO 2013/173652 A1 | 11/2013 |
| WO | WO 2014/043544 A1 | 3/2014 |
| WO | WO 2014/076195 A1 | 5/2014 |
| WO | WO 2014/197826 A1 | 12/2014 |
| WO | WO 2015/035476 A1 | 3/2015 |

OTHER PUBLICATIONS

GenBank accession No. AM750048 [online] submitted Jul. 12, 2007 [retrieved on Apr. 25, 2017] Retrieved from the internet: https://www.ncbi.nlm.nih.gov/nuccore/AM750048.*
International Preliminary Report on Patentability for Application No. PCT/US2013/041440 dated Nov. 27, 2014.
International Preliminary Report on Patentability for Application No. PCT/US2013/041452 dated Nov. 27, 2014.
International Search Report and Written Opinion for Application No. PCT/US2013/041382 dated Sep. 5, 2013.
International Preliminary Report on Patentability for Application No. PCT/US2013/041382 dated Nov. 27, 2014.
International Preliminary Report on Patentability for Application No. PCT/US2013/041381 dated Nov. 27, 2014.
International Preliminary Report on Patentability for Application No. PCT/US2013/041455 dated Nov. 27, 2014.
International Preliminary Report on Patentability for Application No. PCT/US2013/041389 dated Nov. 27, 2014.
International Preliminary Report on Patentability for Application No. PCT/US2013/041385 dated Nov. 27, 2014.
International Preliminary Report on Patentability for Application No. PCT/US2013/041394 dated Nov. 27, 2014.
International Preliminary Report on Patentability for Application No. PCT/US2013/041434 dated Nov. 27, 2014.
International Preliminary Report on Patentability for Application No. PCT/US2013/041437 dated Nov. 27, 2014.
International Search Report and Written Opinion for Application No. PCT/US2013/041461 dated Aug. 21, 2013.
International Preliminary Report on Patentability for Application No. PCT/US2013/041461 dated Nov. 27, 2014.
International Search Report and Written Opinion for Application No. PCT/US2014/041345 dated Oct. 14, 2014.
Extended European Search Report for Application No. EP 11840099.3 dated Oct. 7, 2014.
International Search Report and Written Opinion for Application No. PCT/US2011/060493 dated Apr. 18, 2012.
European Search Report for Application No. EP 11852141.8 dated Jan. 19, 2015.
International Search Report and Written Opinion for Application No. PCT/US2011/065939 dated Apr. 20, 2012.
Genbank Submission; NIH/NCBI, Accession No. AA106140. Marra et al., Feb. 4, 1997. 1 page.
Genbank Submission; NIH/NCBI, Accession No. AL137002. Holt, Dec. 13, 2012. 29 pages.
Genbank Submission; NIH/NCBI, Accession No. BX383579. Li et al., Dec. 23, 2010. 1 page.
Genbank Submission; NIH/NCBI, Accession No. NM_001079668. Young et al., Jan. 18, 2014. 4 pages.
Genbank Submission; NIH/NCBI, Accession No. NM_003317. Young et al., Jan. 18, 2014. 4 pages.
Genbank Submission; NIH/NCBI, Accession No. NM_028475. Diez-Roux et al., Feb. 3, 2014. 6 pages.

[No Author Listed], Geneimprint. 2012. http://www.geneimprint.com/site/about-this-site [last accessed May 22, 2015]. 1 page.
[No Author Listed], Imprinted gene. Mosby's Dictionary of Medicine, Nursing and Health Professions. 8th ed. 2009;949.
Ahn et al., Retinoic acid accelerates downregulation of the Xist repressor, Oct. 4, and increases the likelihood of Xist activation when Tsix is deficient. BMC Develop Biol. 2010;10:90. 14 pages.
Astuti et al., Epigenetic alteration at the DLK1-GTL2 imprinted domain in human neoplasia: analysis of neuroblastoma, phaeochromocytoma and Wilms' tumour. Br J Cancer. Apr. 25, 2005;92(8):1574-80.
Beletskii et al., PNA interference mapping demonstrates functional domains in the noncoding RNA Xist. Proc Natl Acad Sci U S A. Jul. 31, 2001;98(16):9215-20.
Bernardi et al., Structure, dynamics and functions of promyelocytic leukaemia nuclear bodies. Nat Rev Mol Cell Biol. Dec. 2007;8(12):1006-16. Review.
Bernstein et al., Mouse polycomb proteins bind differentially to methylated histone H3 and RNA and are enriched in facultative heterochromatin. Mol Cell Biol. Apr. 2006;26(7):2560-9.
Bernstein et al., RNA meets chromatin. Genes Dev. Jul. 15, 2005;19(14):1635-55. Review.
Boyer et al., Polycomb complexes repress developmental regulators in murine embryonic stem cells. Nature. May 18, 2006;441(7091):349-53. Epub Apr. 19, 2006.
Brockdorff et al., The product of the mouse Xist gene is a 15 kb inactive X-specific transcript containing no conserved ORF and located in the nucleus. Cell. Oct. 30, 1992;71(3):515-26.
Brown et al., A gene from the region of the human X inactivation centre is expressed exclusively from the inactive X chromosome. Nature. Jan. 3, 1991;349:38-44.
Brown et al., The Human XIST Gene: Analysis of a 17 kb Inactive X-Specific RNA That Contains Conserved Repeats and Is Highly Localized within the Nucleus. Cell. Oct. 30, 1992;71:527-42.
Carninci et al., the transcriptional landscape of the mammalian genome. Science. Sep. 2, 2005;309(5740):1559-63.
Chahrour et al., MeCP2, a key contributor to neurological disease, activates and represses transcription. Science. May 30, 2008;320(5880):1224-9.
Chen et al., Decoding the function of nuclear long non-coding RNAs. Curr Opin Cell Biol. Jun. 2010;22(3):357-64. doi: 10.1016/j.ceb.2010.03.003. Epub Mar. 29, 2010. Review.
Chow et al., Inducible XIST-dependent X-chromosome inactivation in human somatic cells is reversible. Proc Natl Acad Sci U S A. Jun. 12, 2007;104(24):10104-9. Epub May 30, 2007.
Clark et al., The Reality of Pervasive Transcription. PLOS Bio. Jul. 2011;9(7):e1000625. 6 pages.
Clemson et al., XIST RNA paints the inactive X chromosome at interphase: evidence for a novel RNA involved in nuclear/chromosome structure. J Cell Biol. Feb. 1996;132(3):259-75.
Cohen et al., X-chromosome inactivation and the search for chromosome-wide silencers. Curr Opin Genet Dev. 2002;12:219-24.
Coombes et al., Epigenetic properties and identification of an imprint mark in the Nesp-Gnasxl domain of the mouse Gnas imprinted locus. Mol Cell Biol. Aug. 2003;23(16):5475-88.
Core et al., Nascent RNA sequencing reveals widespread pausing and divergent initiation at human promoters. Science. Dec. 19, 2008;322(5909):1845-8. doi: 10.1126/science.1162228. Epub Dec. 4, 2008.
Costa, Non-coding RNAs: new players in eukaryotic biology. Gene. Sep. 12, 2005;357(2):83-94. Review.
Daughters et al., RNA gain-of-function in spinocerebellar ataxia type 8. PLoS Genet. Aug. 2009;5(8):e1000600. doi: 10.1371/journal.pgen.1000600. Epub Aug. 14, 2009.
Davidson et al., Singles engage the RNA interference pathway. Cell. Aug. 31, 2012;150(5):873-5. doi: 10.1016/j.cell.2012.08.008.
Denisenko et al., Point mutations in the WD40 domain of Eed block its interaction with Ezh2. Mol Cell Biol. Oct. 1998;18(10):5634-42.
Di Certo et al., The artificial gene Jazz, a transcriptional regulator of utrophin, corrects the dystrophic pathology in mdx mice. Hum Mol Genet. Mar. 1, 2010;19(5):752-60. doi: 10.1093/hmg/ddp539. Epub Dec. 4, 2009.

(56) References Cited

OTHER PUBLICATIONS

Dinger et al., NRED: a database of long noncoding RNA expression. Nucleic Acids Res. Jan. 2009;37(Database issue):D122-6. doi: 10.1093/nar/gkn617. Epub Oct. 1, 2008.
Dominski et al., Identification and characterization by antisense oligonucleotides of exon and intron sequences required for splicing. Mol Cell Biol. Nov. 1994; 14(11): 7445-7454.
Dominski et al., Restoration of correct splicing in thalassemic pre-mRNA by antisense oligonucleotides. Proc Natl Acad Sci U S A. Sep. 15, 1993;90(18):8673-7.
Duthie et al., Xist RNA exhibits a banded localization on the inactive X chromosome and is excluded from autosomal material in cis. Hum Mol Genet. Feb. 1999;8(2):195-204.
Edwards et al., Mechanisms regulating imprinted genes in clusters. Curr Opin Cell Biol. Jun. 2007;19(3):281-9. Review.
Engström et al., Complex Loci in human and mouse genomes. PLoS Genet. Apr. 2006;2(4):e47. Epub Apr. 28, 2006.
Faghihi et al., Expression of a noncoding RNA is elevated in Alzheimer's disease and drives rapid feed-forward regulation of [beta]-secretase. Nat Med. Jul. 2008;14(7):723-30. doi:10.1038/nm1784. Epub Feb. 23, 2010. 19 pages.
Francis et al., Reconstitution of a functional core polycomb repressive complex. Mol Cell. Sep. 2001;8(3):545-56.
Frieden et al., Expanding the design horizon of antisense oligonucleotides with alpha-L-LNA, Nucleic Acids Res., Nov. 1, 2003, 31(21):6365-72.
Froberg et al., Guided by RNAs: X-inactivation as a model for lncRNA function. J Mol Biol. Oct. 9, 2013;425(19):3698-706. doi: 10.1016/j.jmb.2013.06.031. Epub Jun. 28, 2013. Review. 15 pages.
Fu et al., Mir-144 selectively regulates embryonic alpha-hemoglobin synthesis during primitive erythropoiesis. Blood. Feb. 5, 2009;113(6):1340-9.
Golding et al., Depletion of Kcnq1ot1 non-coding RNA does not affect imprinting maintenance in stem cells. Development. 2011;138:3667-8. doi:10.1242/dev.057778.
Gontan et al., Long Noncoding RNAs and X Chromosome Inactivation. Prog Mol Subcell Biol. 2011;51:43-64. doi: 10.1007/978-3-642-16502-3_3.
Guo et al., High resolution genome wide binding event finding and motif discovery reveals transcription factor spatial binding constraints. PLoS Comput Biol. 2012;8(8):e1002638. doi: 10.1371/journal.pcbi.1002638. Epub Aug. 9, 2012.
Gupta et al., Long non-coding RNA HOTAIR reprograms chromatin state to promote cancer metastasis. Nature. Apr. 15, 2010;464(7291):1071-6. doi: 10.1038/nature08975. E-pub version.
Guttman et al., Chromatin signature reveals over a thousand highly conserved large non-coding RNAs in mammals. Nature. Mar. 12, 2009;458(7235):223-7. doi: 10.1038/nature07672. Epub Sep. 30, 2009. 13 pages.
Guttman et al., Modular regulatory principles of large non-coding RNAs. Nature. Feb. 15, 2012;482(7385):339-46. Review.
Hendrich et al., Evolutionary conservation of possible functional domains of the human and murine XIST genes. Human Molec Gen. 1993;2(6):663-72.
Horike et al., Targeted disruption of the human LIT1 locus defines a putative imprinting control element playing an essential role in Beckwith-Wiedemann syndrome. Hum Mol Genet. Sep. 1, 2000;9(14):2075-83.
Inesi et al., Studies of Ca2+ ATPase (SERCA) inhibition. J Bioenerg Biomembr. Dec. 2005;37(6):365-8. Review.
Inouye, Antisense RNA: its functions and applications in gene regulation—a review. Gene. Dec. 10, 1988;72(1-2):25-34.
Jeon et al., YY1 tethers Xist RNA to the inactive X nucleation center. Cell. Jul. 8, 2011;146(1):119-33. doi: 10.1016/j.cell.2011.06.026.
Jepsen et al., Locked nucleic acid: a potent nucleic acid analog in therapeutics and biotechnology. Oligonucleotides. 2004;14(2):130-46. Review.
Jia et al., Genome-wide computational identification and manual annotation of human long noncoding RNA genes. RNA. Aug. 2010;16(8):1478-87. doi: 10.1261/rna.1951310. Epub Jun. 29, 2010.
Johansson et al., Target-specific arrest of mRNA translation by antisense 2'-O-alkyloligoribonucleotides. Nucleic Acids Res. Nov. 11, 1994;22(22):4591-8.
Johnson, Long non-coding RNAs in Huntington's disease neurodegeneration. Neurobiol Dis. 2012;46:245-54.
Kanduri et al., The length of the transcript encoded from the Kcnq1ot1 antisense promoter determines the degree of silencing. EMBO J. 2006;25:2096-106.
Kanhere et al., Short RNAs are transcribed from repressed polycomb target genes and interact with polycomb repressive complex-2. Mol Cell. Jun. 11, 2010;38(5):675-88. doi: 10.1016/j.molcel.2010.03.019.
Kapranov et al., Genome-wide transcription and the implications for genomic organization. Nat Rev Genet. Jun. 2007, 8(6):413-23.
Kapranov et al., RNA maps reveal new RNA classes and a possible function for pervasive transcription. Science. Jun. 8, 2007;316(5830):1484-8.
Khalil et al., Many human large intergenic noncoding RNAs associate with chromatin-modifying complexes and affect gene expression. Proc Natl Acad Sci U S A. Jul. 14, 2009;106(28):11667-72.
Kim et al., Identification of clustered YY1 binding sites in imprinting control regions. Genome Res. Jul. 2006;16(7):901-11. Epub Jun. 7, 2006.
Klein et al., Homeostatic regulation of MeCP2 expression by a CREB-induced microRNA. Nat Neurosci. Dec. 2007;10(12):1513-4.
Krützfeldt et al., Silencing of microRNAs in vivo with 'antagomirs'. Nature. Dec. 1, 2005;438(7068):685-9. Epub Oct. 30, 2005.
Ku et al., Genomewide analysis of PRC1 and PRC2 occupancy identifies two classes of bivalent domains. PLoS Genet. Oct. 2008;4(10):e1000242. doi: 10.1371/journal.pgen.1000242. Epub Oct. 31, 2008. 14 pages.
Lee et al., A 450 kb Transgene Displays Properties of the Mammalian X-Inactivation Center. Cell. Jul. 12, 1996;86:83-94.
Lee et al., Control of developmental regulators by Polycomb in human embryonic stem cells. Cell. Apr. 21, 2006;125(2):301-13.
Lee et al., Genetic analysis of the mouse X inactivation center defines an 80-kb multifunction domain. Proc Natl Acad Sci U S A. Mar. 30, 1999;96(7):3836-41.
Lee et al., Targeted Mutagenesis of Tsix Leads to Nonrandom X Inactivation. Cell. Oct. 1, 1999;99:47-57.
Lee et al., Tsix, a gene antisense to Xist at the X-inactivation centre. Nat Genet. Apr. 1999;21:400-4.
Lee, Disruption of Imprinted X Inactivation by Parent-of-Origin Effects at Tsix. Cell. Sep. 29, 2000;103:17-27.
Lee, Epigenetic regulation by long noncoding RNAs. Science. Dec. 14, 2012;338(6113):1435-9. Review.
Lee, Homozygous Tsix mutant mice reveal a sex-ratio distortion and revert to random X-inactivation. Nat Genet. Sep. 2002;32:195-200.
Lee, Lessons from X-chromosome inactivation: long ncRNA as guides and tethers to the epigenome. Genes Dev. Aug. 15, 2009;23(16):1831-42. doi: 10.1101/gad.1811209.
Lee, The X as a Model for RNA's Niche in Epigenomic Regulation. Cold Spring Harb Perspect Biol. 2010;2:A003749. 12 pages.
Li et al., Jarid2 and PRC2, partners in regulating gene expression. Genes Dev. Feb. 15, 2010;24(4):368-80. doi: 10.1101/gad.1886410. Epub Feb. 1, 2010.
Lima et al., Single-stranded siRNAs activate RNAi in animals. Cell. Aug. 31, 2012;150(5):883-94. doi: 10.1016/j.cell.2012.08.014.
Lin et al., An in-depth map of polyadenylation sites in cancer. Nucleic Acids Res. Sep. 1, 2012;40(17):8460-71. Epub Jun. 29, 2012.
Lin et al., Asymmetric regulation of imprinting on the maternal and paternal chromosomes at the Dlk1-Gtl2 imprinted cluster on mouse chromosome 12. Nat Genet. Sep. 2003;35(1):97-102. Epub Aug. 24, 2003.
Lipovich et al., MacroRNA underdogs in a microRNA world: evolutionary, regulatory, and biomedical significance of mammalian long non-protein-coding RNA. Biochim Biophys Acta. Sep. 2010;1799(9):597-615. Review.

(56) References Cited

OTHER PUBLICATIONS

Margueron et al., The Polycomb complex PRC2 and its mark in life. Nature. Jan. 20, 2011;469(7330):343-9. Review.
Mercer et al., Long non-coding RNAs: insights into functions. Nat Rev Genet. Mar. 2009;10(3):155-9. Review.
Mercer et al., Structure and function of long noncoding RNAs in epigenetic regulation. Mar. 5, 2013;20:300-7.
Merienne et al., SCA8 CAG/CTG expansions, a tale of two TOXICities: a unique or common case? PLoS Genet. Aug. 2009;5(8):e1000593. doi: 10.1371/journal.pgen.1000593. Epub Aug. 14, 2009.
Miremadi et al., Cancer genetics of epigenetic genes. Hum Mol Genet. Apr. 15, 2007;16 Spec No. 1:R28-49. Review.
Miura et al., Utrophin upregulation for treating Duchenne or Becker muscular dystrophy: how close are we? Trends Mol Med. Mar. 2006;12(3):122-9. Epub Jan. 27, 2006.
Modarresi et al., Natural Antisense Inhibition Results in Transcriptional De-Repression and Gene Upregulation. Nat Biotechnol. Mar. 25, 2012;30(5):453-9. doi: 10.1038/nbt.2158. 21 pages.
Montgomery et al., The murine polycomb group protein Eed is required for global histone H3 lysine-27 methylation. Curr Biol. May 24, 2005;15(10):942-7.
Morris et al., Small interfering RNA-induced transcriptional gene silencing in human cells. Science. Aug. 27, 2004;305(5688):1289-92. Epub Aug. 5, 2004.
Morris, RNA-mediated transcriptional gene silencing in human cells. Curr Top Microbiol Immunol. 2008;320:211-24. Review.
Munroe, Antisense RNA inhibits splicing of pre-mRNA in vitro. EMBO J. Aug. 1988; 7(8): 2523-32.
Nagano et al., The Air noncoding RNA epigenetically silences transcription by targeting G9a to chromatin. Science. Dec. 12, 2008;322(5908):1717-20.
Nie et al., Long non-coding RNAs: versatile master regulators of gene expression and crucial players in cancer. Am J Transl Res. 2012;4(2):127-50. Epub Apr. 8, 2012.
Numata et al., Comparative analysis of cis-encoded antisense RNAs in eukaryotes. Gene. May 1, 2007;392(1-2):134-41.
Numata et al., Identification of novel endogenous antisense transcripts by DNA microarray analysis targeting complementary strand of annotated genes. BMC Genomics. Aug. 22, 2009;10:392. doi: 10.1186/1471-2164-10-392.
Okada et al., Comparative expression analysis uncovers novel features of endogenous antisense transcription. Hum Mol Genet. Jun. 1, 2008;17(11):1631-40. doi: 10.1093/hmg/ddn051. Epub Feb. 18, 2008.
Ørom et al., LNA-modified oligonucleotides mediate specific inhibition of microRNA function. Gene. May 10, 2006;372:137-41. Epub Feb. 24, 2006.
Ozsolak et al., Comprehensive polyadenylation site maps in yeast and human reveal pervasive alternative polyadenylation. Cell. Dec. 10, 2010;143(6):1018-29. doi: 10.1016/j.cell.2010.11.020.
Pandey et al., Kcnq1ot1 antisense noncoding RNA mediates lineage-specific transcriptional silencing through chromatin-level regulation. Mol Cell. Oct. 24, 2008;32(2):232-46. doi: 10.1016/j.molcel.2008.08.022.
Paro et al., Extending the frontiers of epigenetic regulation. Curr Opin Genet Dev. Apr. 2010;20(2):107-9. doi: 10.1016/j.gde.2010.03.011.
Pasini et al., Suz12 is essential for mouse development and for EZH2 histone methyltransferase activity. EMBO J. Oct. 13, 2004;23(20):4061-71. Sep. 23, 2004.
Peng et al., Jarid2/Jumonji coordinates control of PRC2 enzymatic activity and target gene occupancy in pluripotent cells. Cell. Dec. 24, 2009;139(7):1290-302. doi: 10.1016/j.cell.2009.12.002. Epub Jul. 29, 2010 24 pages.
Penny et al., Requirement for Xist in X chromosome inactivation. Nature. Jan. 11, 1996;379(6561):131-7.
Pereira et al., Ezh2, the histone methyltransferase of PRC2, regulates the balance between self-renewal and differentiation in the cerebral cortex. Proc Natl Acad Sci U S A. Sep. 7, 2010;107(36):15957-62. doi: 10.1073/pnas.1002530107. Epub Aug. 23, 2010.
Petersen et al., LNA: A versatile tool for therapeutics and genomics. Trends Biotech. Feb. 2003;21(2):74-81. Review.
Pietersen et al., Stem cell regulation by polycomb repressors: postponing commitment. Curr Opin Cell Biol. Apr. 2008;20(2):201-7. doi: 10.1016/j.ceb.2008.01.004. Epub Mar. 4, 2008. Review.
Plath et al., Role of Histone H3 Lysine 27 Methylation in X Inactivation. Science. Apr. 4, 2003;300:131-5. doi: 10.1126/science.1084274.
Ponting et al., Evolution and functions of long noncoding RNAs. Cell. Feb. 20, 2009;136(4):62941. doi: 10.1016/j.cell.2009.02.006. Review.
Qi et al., Repurposing CRISPR as an RNA-guided platform for sequence-specific control of gene expression. Cell. Feb. 28, 2013;152(5):1173-83. doi: 10.1016/j.cell.2013.02.022.
Rajasekhar et al., Concise review: roles of polycomb group proteins in development and disease: a stem cell perspective. Stem Cells. Oct. 2007;25(10):2498-510. Epub Jun. 28, 2007. Review.
Redrup et al., The long noncoding RNA Kcnq1ot1 organises a lineage-specific nuclear domain for epigenetic gene silencing. Development. Feb. 2009;136(4):525-30. doi: 10.1242/dev.031328. Epub Jan. 14, 2009. 14 pages.
Ringrose et al., Epigenetic regulation of cellular memory by the Polycomb and Trithorax group proteins. Annu Rev Genet. 2004;38:413-43. Review.
Rinn et al., Functional demarcation of active and silent chromatin domains in human HOX loci by noncoding RNAs. Cell. Jun. 29, 2007;129(7):1311-23.
Rinn et al., Genome Regulation by Long Noncoding RNAs. Annu Rev Biochem. 2012;81:145-66.
Røsok et al., Systematic identification of sense-antisense transcripts in mammalian cells. Nat Biotechnol. Jan. 2004;22(1):104-8. Epub Dec. 14, 2004.
Sankaran et al., MicroRNA-15a and -16-1 act via MYB to elevate fetal hemoglobin expression in human trisomy 13. Proc Natl Acad Sci U S A. Jan. 25, 2011;108(4):1519-24.
Sankaran, Targeted therapeutic strategies for fetal hemoglobin induction. Hematol Am Soc Hematol Educ Program. 2011;2011:459-65.
Sarma et al., Locked nucleic acids (LNAs) reveal sequence requirements and kinetics of Xist RNA localization to the X chromosome. Proc Natl Acad Sci U S A. Dec. 21, 2010;107(51):22196-201. doi: 10.1073/pnas.1009785107. Epub Dec. 6, 2010.
Saxena et al., Long non-coding RNA modifies chromatin. Bioessays. 2011;33:830-9. Review.
Schoeftner et al., Recruitment of PRC1 function at the initiation of X inactivation independent of PRC2 and silencing. EMBO J. Jul. 12, 2006;25(13):3110-22. Epub Jun. 8, 2006.
Schuettengruber et al., Genome regulation by polycomb and trithorax proteins. Cell. Feb. 23, 2007;128(4):735-45.
Schultz et al., Enhancers compete with a long non-coding RNA for regulation of the Kcnq1 domain. Nucl Acids Res. 2015;43(2):745-59.
Schwartz et al., Genome-wide analysis of Polycomb targets in *Drosophila melanogaster*. Nat Genet. Jun. 2006;38(6):700-5.
Schwartz et al., Polycomb complexes and epigenetic states. Curr Opin Cell Biol. 2008;20:266-73. doi: 10.1016/j.ceb.2008.03.002.
Seong et al., Huntingtin facilitates polycomb repressive complex 2. Hum Mol Genet. Feb. 15, 2010;19(4):573-83. doi: 10.1093/hmg/ddp524. Epub Nov. 23, 2009.
Shaver et al., Origin of the polycomb repressive complex 2 and gene silencing by an E(z) homolog in the unicellular alga Chlamydomonas. Epigenetics. May 16, 2010;5(4):301-12. Epub May 24, 2010.
Shen et al,. EZH1 mediates methylation on histone H3 lysine 27 and complements EZH2 in maintaining stem cell identity and executing pluripotency. Mol Cell. Nov. 21, 2008;32(4):491-502. doi: 10.1016/j.molcel.2008.10.016.
Shen et al., Jumonji modulates polycomb activity and self-renewal versus differentiation of stem cells. Cell. Dec. 24, 2009;139(7):1303-14. doi: 10.1016/j.cell.2009.12.003. Epub Jun. 24, 2010. 26 pages.
Shore et al., Pregnancy-induced noncoding RNA (PINC) associates with polycomb repressive complex 2 and regulates mammary epithelial differentiation. PLoS Genet. 2012;8(7):e1002840. doi: 10.1371/journal.pgen.1002840. Epub Jul. 26, 2012.

(56) References Cited

OTHER PUBLICATIONS

Simon et al., High-resolution Xist binding maps reveal two-step spreading during X-chromosome inactivation. Nature. Dec. 19, 2013;504(7480):465-9. doi: 10.1038/nature12719. Epub Oct. 27, 2013.
Simon et al., Roles of the EZH2 histone methyltransferase in cancer epigenetics. Mutat Res. Dec. 1, 2088;647(1-2):21-9. Review.
Sing et al., A vertebrate Polycomb response element governs segmentation of the posterior hindbrain. Cell. Sep. 4, 2009;138(5):885-97. doi: 10.1016/j.cell.2009.08.020.
Sparmann et al., Polycomb silencers control cell fate, development and cancer. Nat Rev Cancer. Nov. 2006;6(11):846-56. Review.
Taft et al., Non-coding RNAs: regulators of disease. J Pathol. Jan. 2010;220(2):126-39. doi: 10.1002/path.2638. Review.
Taft et al., Tiny RNAs associated with transcription start sites in animals. Nat Genet. May 2009;41(5):572-8. doi: 10.1038/ng.312. Epub Apr. 19, 2009. Erratum in: Nat Genet. Jul. 2009;41(7):859.
Takagi et al., Role of Sp1 in transcription of human ATP2A2 gene in keratinocytes. J Invest Dermatol. Jan. 2008;128(1):96-103. Epub Jun. 28, 2007.
Takahashi et al., Deletion of Gtl2, imprinted non-coding RNA, with its differentially methylated region induces lethal parent-origin-dependent defects in mice. Hum Mol Genet. May 15, 2009;18(10):1879-88. doi: 10.1093/hmg/ddp108. Epub Mar. 4, 2009.
Tano et al., MALAT-1 enhances cell motility of lung adenocarcinoma cells by influencing the expression of motility-related genes. FEBS Lett. Nov. 19, 2010;584(22):4575-80. doi: 10.1016/j.febslet.2010.10.008. Epub Oct. 13, 2010.
Thorvaldsen et al., A YY1 bridge for X inactivation. Cell. Jul. 8, 2011;146(1):11-3. doi: 10.1016/j.cell.2011.06.029.
Thorvaldsen et al., SnapShot: imprinted gene clusters. Cell. Sep. 7, 2007;130(5):958.
Tian et al., The long noncoding RNA, Jpx, is a molecular switch for X chromosome inactivation. Cell. Oct. 29, 2010;143(3):390-403. doi: 10.1016/j.cell.2010.09.049. 21 pages.
Tsai et al., Higher order chromatin structure at the X-inactivation center via looping DNA. Dev Biol. Jul. 15, 2008;319(2):416-25. doi: 10.1016/j.ydbio.2008.04.010. Epub Apr. 18, 2008. 22 pages.
Tsai et al., Long noncoding RNA as modular scaffold of histone modification complexes. Science. Aug. 6, 2010;329(5992):689-93. doi: 10.1126/science.1192002. Epub Nov. 2, 2010. 9 pages.
Vickers et al., Fully modified 2' MOE oligonucleotides redirect polyadenylation. Nucleic Acids Res. Mar. 15, 2001;29(6):1293-9.
Wahlestedt, Natural antisense and noncoding RNA transcripts as potential drug targets. Drug Discov Today. Jun. 2006;11(11-12):503-8.
Wahlestedt, Targeting long non-coding RNA to therapeutically upregulate gene expression. Nature Rev Drug Disc. Jun. 2013;12:433-46. Review.
Wan et al., Regulation of imprinting in clusters: noncoding RNAs versus insulators. Adv Genet. 2008;61:207-23. Review.
Wang et al., Long non-coding RNA UCA1a(CUDR) promotes proliferation and tumorigenesis of bladder cancer. Int J Oncol. Jul. 2012;41(1):276-84.
Wang et al., Molecular mechanisms of long noncoding RNAs. Cell Press. Sep. 16, 2011; 43(6):904-14.
Williamson et al., Identification of an imprinting control region affecting the expression of all transcripts in the Gnas cluster. Nat Genet. Mar. 2006;38(3):350-5.
Wilusz et al., A triple helix stabilizes the 3' ends of long noncoding RNAs that lack poly(A) tails. Genes Dev. Nov. 1, 2012;26(21):2392-407. doi: 10.1101/gad.204438.112. Epub Oct. 16, 2012.
Woo et al., A Region of theHuman HOXDCluster that Confers Polycomb-Group Responsiveness. Cell. Jan. 8, 2010;140:99-110.
Wutz et al., A Shift from Reversible to Irreversible X Inactivation Is Triggered during ES Cell Differentiation. Molec Cell. Apr. 2000;5:695-705.

Xiong et al., Polycomb antagonizes p300/CREB-binding protein associated factor to silence FOXP3 in a Kruppel-like factor-dependent manner. J Biol Chem. Oct. 5, 2012;287(41):34372-85. doi: 10.1074/jbc.M111.325332. Epub Aug. 15, 2012.
Yang et al., Long noncoding RNAs: fresh perspectives into the RNA world. Trends Biochem Sci. Jan. 2014;39(1):35-43. doi: 10.1016/j.tibs.2013.10.002. Epub Nov. 27, 2013. Review.
Yap et al., Molecular interplay of the noncoding RNA ANRIL and methylated histone H3 lysine 27 by polycomb CBX7 in transcriptional silencing of INK4a. Mol Cell. Jun. 11, 2010 ;38(5):662-74. doi: 10.1016/j.molcel.2010.03.021. Epub Jun. 11, 2011. 23 pages.
Yatsuki et al., Sequence-based structural features between Kvlqt1 and Tapa1 on mouse chromosome 7F4/F5 corresponding to the Beckwith-Wiedemann syndrome region on human 11p15.5: long-stretches of unusually well conserved intronic sequences of kvlqt1 between mouse and human. DNA Res. Jun. 30, 2000;7(3):195-206.
Yu et al., Single-stranded RNAs use RNAi to potently and allele-selectively inhibit mutant huntingtin expression. Cell. Aug. 31, 2012;150(5):895-908. doi: 10.1016/j.cell.2012.08.002.
Zhang et al., Long noncoding RNA-mediated intrachromosomal interactions promote imprinting at the Kcnq1 locus. J Cell Biol. 2014;204(1):61-75.
Zhang et al., NATsDB: Natural Antisense Transcripts DataBase. Nucleic Acids Res. Jan. 2007;35(Database issue):D156-61. Epub Nov. 1, 2006.
Zhang et al., Perinucleolar Targeting of the Inactive X during S Phase: Evidence for a Role in the Maintenance of Silencing. Cell. May 18, 2007;129:693-706.
Zhao et al., Genome-wide identification of polycomb-associated RNAs by RIP-seq. Mol Cell. Dec. 22, 2010;40(6):939-53.
Zhao et al., Polycomb proteins targeted by a short repeat RNA to the mouse X-chromosome. Science. 2008; 322(5902):750-756. doi:10.1126/science.1163045. E-pub version.
Submission. EBI Accession No. EMBL:GC092872. Palma et al. Aug. 31, 2008.
Genbank Submission; NCBI, Accession No. AM911724.1; Talwar et al. Nov. 26, 2007.
Genbank Submission; NCBI, Accession No. NM_022876.2. Apr. 2010. 5 pages.
[No Author Listed], New England BioLabs 1998/99 Catalog. 121, 284.
[No Author Listed] Catalogue of Parent of Origin Effects, Imprinted Genes and Related Effects, Parental Origins of de novo Mutations, downloaded at http://igc.otago.ac.nz/home.html on May 22, 2015, 2 pgs.
[No Author Listed] Locked Nucleic Acid. Exiqon. 2009. Retrieved from http://www.exiqon.com/ls/documents/scientific/lna_folder.pdf on Jun. 6, 2016.
[No Author Listed] UCSC Genome Browser on Human Feb. 2009 (GRCh37/hg19) Assembly. Retrieved from http://genome.ucsc.edu/cgi-bin/hgTracks?db=hgl 9&position=chr5%3A 702 11 956-7027 1 955&hgsid=452570083 _sxavccF ldzrwhzM3tcNOyMcxbye 7 on Nov. 9, 2015.
Aartsma-Rus et al., Antisense-induced multiexon skipping for Duchenne muscular dystrophy makes more sense. Am J Hum Genet. Jan. 2004;74(1):83-92.
Bauer et al., The quest for mammalian Polycomb response elements: are we there yet? Chromosoma. Jun. 2016;125(3):471-96. doi:10.1007/s00412-015-0539-4.
Buck et al., Design strategies and performance of custom DNA sequencing primers. Biotechniques. Sep. 1999;27(3):528-36.
Crea et al., Pharmacologic disruption of Polycomb Repressive Complex 2 inhibits tumorigenicity and tumor progression in prostate cancer. Mol Cancer. Apr. 18, 2011;10:40. doi: 10.1186/14764598-10-40.
Davidovich et al., Toward a consensus on the binding specificity and promiscuity of PRC2 for RNA. Mol Cell. Feb. 5, 2015;57(3):552-8. doi: 10.1016/j.molcel.2014.12.017. Epub Jan. 15, 2015.
Dheda et al., Validation of housekeeping genes for normalizing RNA expression in real-time PCR. Biotechniques. Jul. 2004;37(1):112-4, 116, 118-9.
Dias et al., Antisense oligonucleotides: basic concepts and mechanisms. Mol Cancer Ther. Mar. 2002;1(5):347-55.

(56) References Cited

OTHER PUBLICATIONS

Ebralidze et al., PU.1 expression is modulated by the balance of functional sense and antisense RNAs regulated by a shared cis-regulatory element. Genes Dev. Aug. 1, 2008;22(15):2085-92. doi:10.1101/gad.1654808. Supplemental Data.
Eddy, Non-coding RNA genes and the modern RNA world. Nat Rev Genet. Dec. 2001;2(12):919-29.
Fish et al., Hypoxia-inducible expression of a natural cis-antisense transcript inhibits endothelial nitric-oxide synthase. J Biol Chem. May 25, 2007;282(21):15652-66. Epub Apr. 2, 2007.
Gajera et al., Molecular and biochemical characterization of Trichoderma isolates inhibiting a phytopathgenic fungi *Asperillus niger* Van Tieghem. Phys Mol Plant Path. 2010;74:274-282.
Hernandez et al., Degradation of nuclease-stabilized RNA oligonucleotides in Mycoplasma-contaminated cell culture media. Nucleic Acid Ther. Feb. 2012;22(1):58-68. doi: 10.1089/nat.2011.0316. Epub Jan. 9, 2012.
Huang, Shoujun et al., Non-encoding RNA and development of animals, Science China Life Science, Dec. 31, 2009; pp. 21-30.
Inoue et al., Synthesis and hybridization studies on two complementary nona(2'-O-methyl)ribonucleotides. Nucleic Acids Res. Aug. 11, 1987;15(15):6131-48.
Jackson et al., Expression profiling reveals off-target gene regulation by RNAi. Nat Biotechnol. Jun. 2003;21(6):635-7. Epub May 18, 2003.
Keil et al., A short antisense oligonucleotide ameliorates symptoms of severe mouse models of spinal muscular atrophy. Mol. Ther Nucleic Acids. Jul. 8, 2014;3:e174. doi: 10.1038/mtna.2014.23.
Kierzek et al., The influence of locked nucleic acid residues on the thermodynamic properties of 2'-O-methyl RNA/RNA heteroduplexes. Nucleic Acids Res. Sep. 9, 2005 ;33(16):5082-93. Print 2005.
Lacerra et al., Restoration of hemoglobin A synthesis in erythroid cells from peripheral blood of thalassemic patients. Proc Natl Acad Sci U S A. Aug. 15, 2000;97(17):9591-6.
Lapointe et al., Gene expression profiling identifies clinically relevant subtypes of prostate cancer. Proc Natl Acad Sci U S A. Jan. 20, 2004;101(3):811-6. Epub Jan. 7, 2004.
Latorra et al., Design considerations and effects of LNA in PCR primers. Mol Cell Probes. Oct. 2003;17(5):253-9.
Lennox et al., Improved Performance of Anti-miRNA Oligonucleotides Using a Novel Non-Nucleotide Modifier. Mol Ther Nucleic Acids. Aug. 27, 2013;2:e117. doi: 10.1038/mtna.2013.46.
Morse et al., Depleting regulatory T cells with arginine-rich, cell-penetrating, peptide-conjugated morpholino oligomer targeting FOXP3 inhibits regulatory T-cell function. Cancer Gene Ther. Jan. 2012;19(1):30-7. doi: 10.1038/cgt.2011.63.
Nishida et al., Synthesis, RNA selective hybridization and high nuclease resistance of an oligonucleotide containing novel bridged nucleic acid with cyclic urea structure. Chem Commun (Camb). Aug. 7, 2010;46(29):5283-5. doi: 10.1039/c0cc00154f. Epub Jun. 22, 2010.
Rozen et al., Primer3 on the WWW for general users and for biologist programmers. Methods Mol Biol. 2000;132:365-86.
Schadt et al., An integrative genomics approach to infer causal associations between gene expression and disease. Nat Genet. Jul. 2005;37(7):710-7. Epub Jun. 19, 2005.
Schwartz et al., Polycomb silencing mechanisms and the management of genomic programmes. Nat Rev Genet. Jan. 2007;8(1):9-22.
Singh et al., A short antisense oligonucleotide masking a unique intronic motif prevents skipping of a critical exon in spinal muscular atrophy. RNA Biol. Jul.-Aug. 2009;6(3):341-50. Epub Jul. 14, 2009
Suwanmanee et al., Restoration of human beta-globin gene expression in murine and human IVS2-654 thalassemic erythroid cells by free uptake of antisense oligonucleotides. Mol Pharmacol. Sep. 2002;62(3):545-53.
Varela et al., Natural Antisense Makes Sense for Gene-specific Activation in Brain. Mol Ther Nucleic Acids. May 15, 2012;1:e24. doi: 10.1038/mtna.2012.17.
Venter et al., The sequence of the human genome. Science. Feb. 16, 2001;291(5507):1304-51. Erratum in: Science Jun. 5, 2001;292(5523):1838.
Whitehead et al., Variation in tissue-specific gene expression among natural populations. Genome Biol. 2005;6(2):R13. Epub Jan. 26, 2005
Wilusz et al., Long noncoding RNAs: functional surprises from the RNA world. Genes Dev. Jul. 1, 2009;23(13):1494-504. doi:10.1101/gad.1800909.
Yang et al., High fidelity PCR with an off/on switch mediated by proofreading polymerases combining with phosphorothioate-modified primer. Biochem Biophys Res Commun. Mar. 4, 2005;328(1):265-72. Erratum in: Biochem Biophys Res Commun. Jun. 3, 2005;331(2):682. Zhang, Jia [removed]; Li, Kai [removed].
Yang et al., The histone code regulating expression of the imprinted mouse Igf2r gene. Endocrinology. Dec. 2003;144(12):5658-70.
[No Author Listed] Designing Antisense Oligonucleotides. Integrated DNA Technologies. 2011. 1-16.
[No Author Listed] ncRNA. 2011;29(11):1716-1721.
Alvarez-Salas, Nucleic acids as therapeutic agents. Curr Top Med Chem. 2008;8(15):1379-404.
Behlke et al., Designing antisense oligonucleotides. Integrated DNA Technologies. 2005. 1-17.
Beltran et al., The interaction of PRC2 with RNA or chromatin is mutually antagonistic. Genome Res. Jul. 2016;26(7):896-907. doi:10.1101/gr.197632.115. Epub May 9, 2016.
Braasch et al., Locked nucleic acid (LNA): fine-tuning the recognition of DNA and RNA. Chem Biol. Jan. 2001:8(1):1-7.
Broderick et al., MicroRNA therapeutics. Gene Ther. Dec. 2011;18(12):1104-10. doi: 10.1038/gt.2011.50. Epub Apr. 28, 2011.
Cantafora et al., Evaluation of RNA messengers involved in lipid trafficking of human intestinal cells by reverse-transcription polymerase chain reaction with competimer technology and microchip electrophoresis. Electrophoresis. Nov. 2003;24(21):3748-54.
Crooke et al., Kinetic characteristics of *Escherichia coil* RNase H1: cleavage of various antisense oligonucleotide-RNA duplexes. Biochem J. Dec. 1, 1995;312 ( Pt 2):599-608.
Cuddapah et al., A novel human polycomb binding site acts as a functional polycomb response element in *Drosophila*. PLoS One. 2012;7(5):e36365. doi: 10.1371/journal.pone.0036365. Epub May 3, 2012.
Cushman et al., Synthesis of the covalent hydrate of the incorrectly assumed structure of aurintricarboxylic acid (ATA). Tetrahedron. 1990;46(5):1491-1498.
Davidovich et al., The recruitment of chromatin modifiers by long noncoding RNAs: lessons from PRC2. RNA. Dec. 2015;21(12):2007-22. doi:10.126/rna.053918.115.
Ganguli et al., Antagomirbase—a putative antagomir database. Bioinformation. 2011;7(1):41-3.
Halley et al., Natural antisense transcripts as therapeutic targets. Drug Discov Today Ther Strateg. 2013 Fall;10(3):e119-e125.
He et al., Polycomb repressive complex 2 regulates normal development of the mouse heart. Circ Res. Feb. 3, 2012;110(3):406-15. doi: 10.1161/CIRCRESAHA.111.252205. Epub Dec. 8, 2011.
Kao et al., Tumor necrosis factor-alpha decreases sarcoplasmic reticulum Ca2+-ATPase expressions via the promoter methylation in cardiomyocytes. Crit Care Med. Jan. 2010;38(1):217-22. doi: 10.1097/CCM.0b013e3181b4a854.
Kiss, Small nucleolar RNA-guided post-transcriptional modification of cellular RNAs. EMBO J. Jul. 16, 2001;20(14):3617-22.
Kutyavin et al., Reduced aggregation and improved specificity of G-rich oligodeoxyribonucleotides containing pyrazolo[3,4-d]pyrimidine guanine bases. Nucleic Acids Res. Nov. 15, 2002;30(22):4952-9.
Li et al., CTCF regulates allelic expression of Igf2 by orchestrating a promoter-polycomb repressive complex 2 intrachromosomal loop. Mol Cell Biol. Oct. 2008;28(20):6473-82. doi: 10.1128/MCB.00204-08. Epub Jul. 28, 2008.
Mencia et al., Mutations in the seed region of human miR-96 are responsible for nonsyndromic progressive hearing loss. Nat Genet. May 2009;41(5):609-13. doi: 10.1038/ng.355. Epub Apr. 12, 2009.

(56) References Cited

OTHER PUBLICATIONS

Mendenhall et al., GC-rich sequence elements recruit PRC2 in mammalian ES cells. PLoS Genet. Dec. 9, 2010;6(12):e1001244. doi: 10.1371/journal.pgen.1001244.

Mirguet et al., From ApoA1 upregulation to BET family bromodomain inhibition:discovery of I-BET151. Bioorg Med Chem Lett. Apr. 15, 2012;22(8):2963-7. doi:10.1016/j.bmcl.2012.01.125. Epub Feb. 8, 2012.

Nakao, Gene Cluster control through epigenetic mechanisms and cytopathology. Uehara memorial life science foundation research report collection. 23;2009:1-4.

Prensner et al., Transcriptome sequencing across a prostate cancer cohort identifies PCAT-1, an unannotated lincRNA implicated in disease progression. Nat Biotechnol. Jul. 31, 2011;29(8):742-9. doi: 10.1038/nbt.1914.

Rader, Molecular regulation of HDL metabolism and function: implications for novel therapies. J Clin Invest. Dec. 2006;116(12):3090-100.

Schlesinger et al., Polycomb-mediated methylation on Lys27 of histone H3 pre-marks genes for de novo methylation in cancer. Nat Genet. Feb. 2007;39(2):232-6. Epub Dec. 31, 2006.

Summerton, Morpholino antisense oligomers: the case for an Rnase H-independent structural type. Biochim Biophys Acta. Dec. 10, 1999;1489(1):141-58.

Sun et al., Evidence for a preferential targeting of 3'-UTRs by cis-encoded natural antisense transcripts. Nucleic Acids Res. Oct. 4, 2005;33(17):5533-43. Print 2005.

Sun et al., SNPs in human miRNA genes affect biogenesis and function. RNA. Sep. 2009;15(9):1640-51. doi: 10.1261/rna.1560209. Epub Jul. 17, 2009.

Tae et al., Bromodomain protein 7 interacts with PRMT5 and PRC2, and is involved in transcriptional repression of their target genes. Nucleic Acids Res. Jul. 2011;39(13):5424-38. doi: 10.1093/nar/gkr170.

Van Peer et al., miRBase Tracker: keeping track of microRNA annotation changes. Database (Oxford). Aug. 25, 2014;2014. pii:bau080. doi: 10.1093/database/bau080. Print 2014.

Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.

Wu et al., Binding interactions between long noncoding RNA HOTAIR and PRC2 proteins. Biochemistry. Dec. 31, 2013;52(52):9519-27. doi: 10.1021/bi401085h.

Yakali et al., Supramolecular chirality-sensing DNA-mimicry of a norbornane derivative decorated with isoxazoline and methylpyrrolidine-2,5-dione ring. J Mol Structure. Jun. 10, 2013;1041:164-174.

Zhou et al., Targeting RNA-splicing for SMA treatment. Mol Cells. Mar. 2012;33(3):223-8. doi: 10.1007/s10059-012-0005-6.

Arvey et al., Inflammation-induced repression of chromatin bound by the transcription factor Foxp3 in regulatory T cells. Nat Immunol. Jun. 2014;15(6):580-587. doi: 10.1038/ni.2868. Epub Apr. 13, 2014.

Efthymiou et al., Chemical architecture and applications of nucleic acid derivatives containing 1, 2, 3-triazole functionalities synthesized via click chemistry. Molecules. 2012;17(11):12665-12703.

Gooding et al., Oligonucleotide conjugates-Candidates for gene silencing therapeutics. European J Pharmaceutics Biopharmaceutics. 2016;107:321-340. [Epub.]Aug. 10, 2016.

He et al., Conjugation and Evaluation of Triazole-Linked Single Guide RNA for CRISPR-Cas9 Gene Editing. ChemBioChem, 2016;17:1809-1812.

Jayaprakash et al., Non-nucleoside building blocks for copper-assisted and copper-free click chemistry for the efficient synthesis of RNA conjugates. Organic Letters. 2010;12(23):5410-5413.

Matsuda et al., siRNA conjugates carrying sequentially assembled trivalent N-acetylgalactosamine linked through nucleosides elicit robust gene silencing in vivo in hepatocytes. ACS Chemical Biology. 2015;10:1181-1187.

Nair et al., Multivalent N-acetylgalactosamine-conjugated siRNA localizes in hepatocytes and elicits robust RNAi-mediated gene silencing. J American Chemical Society. 2014;136;16958-16961.

Thomas et al., Development of apolipoprotein B antisense molecules as a therapy for hyperlipidemia. Curr Atheroscler Rep. Jan. 2010;12(1):58-65. doi: 10.1007/s11883-009-0078-7.

\* cited by examiner

COMPOSITIONS AND METHODS FOR MODULATING HEMOGLOBIN GENE FAMILY EXPRESSION

CROSS-REFERENCE TO RELATED APPLICATIONS

This application is a national stage filing under U.S.C. § 371 of PCT International Application PCT/US2013/041382, with an international filing date of May 16, 2013, which claims the benefit under 35 U.S.C. § 119(e) of U.S. Provisional Application No. 61/785,956, entitled "COMPOSITIONS AND METHODS FOR MODULATING HEMOGLOBIN GENE FAMILY EXPRESSION", filed Mar. 14, 2013 and U.S. Provisional Application No. 61/647,901, entitled "COMPOSITIONS AND METHODS FOR MODULATING HEMOGLOBIN GENE FAMILY EXPRESSION", filed May 16, 2012, each of which is incorporated herein by reference in its entirety.

GOVERNMENT SUPPORT

This invention was made with Government support under Grant No. R01-GM-090278 awarded by the National Institutes of Health. The Government has certain rights in the invention.

FIELD OF THE INVENTION

The invention relates to oligonucleotide based compositions, as well as methods of using oligonucleotide based compositions for treating disease.

BACKGROUND OF THE INVENTION

Red blood cells are essential for transporting oxygen throughout the body. Red blood cells are made up of hemoglobin, which is a multi-subunit oxygen-transport metalloprotein. During development, embryonic hemoglobin is composed of epsilon chains (encoded by HBE1) and zeta chains and is produced by the embryonic yolk sac. In human infants, hemoglobin is made up of alpha chains (encoded by HBA1 and HBA2) and gamma chains (encoded by HBG1 and HBG2), with the gamma chains gradually replaced by beta chains over time. The majority of hemoglobin in adults is made up of alpha chains and beta chains (encoded by HBB) with a small percentage (about 3%) made up of alpha and delta chains (encoded by HBD). Several disorders are caused by mutations in hemoglobin subunits and affect red blood cell function or production, resulting in anemia. Two major diseases that affect red blood cells include sickle cell anemia and thalassemia.

Sickle cell anemia is a recessive disorder caused by the absence of a polar amino acid at position six of the beta-globin chain due to a point mutation in HBB. The absence of this amino acid causes aggregation of hemoglobin and results in red blood cells having a stiff, sickle shape. The rigidity of these red blood cells results in vessel occlusion and ischaemia as the cells pass through capillary beds. Anemia is also a symptom, due to the excessive lysis of sickle-shaped red blood cells. Mouse models of sickle cell anemia have shown that expression of other hemoglobin subunits can alleviate symptoms. In adult sickle cell anemia mice, for example, expression of HBE1, which is normally not expressed in adults but serves a similar function as beta-chains during embryonic development, restores the mice to a normal phenotype.

Thalassemia is a group of hereditary blood disorders characterized by a reduced amount of hemoglobin and fewer red blood cells. There are several types of thalassemia, including alpha-thalassemia, beta-thalassemia, delta thalassemia. Alpha-thalassemia is caused by mutations in the HBA1 or HBA2 gene. These mutations cause reduction in alpha-globin production and formation of beta-chain tetramers with altered oxygen profiles and anemia. Delta-thalassemia is caused by a reduction in the synthesis of delta chains of hemoglobin, which is encoded by HBD. Beta-thalassemia, the most severe form of thalassemia, is caused by a reduction in the synthesis of the beta chains of hemoglobin, which is encoded by HBB. Beta-thalassemia is classified into three types, thalassemia minor, thalassemia intermedia, and thalassemia major, depending on the number of mutations and disease severity. Thalassemia minor occurs when only one beta globin allele is mutated and results in microcytic anemia. When more than one allele is mutated, thalassemia intermedia or thalassemia major can occur depending on the severity of the mutation. Patients with thalassemia major require blood transfusions or bone marrow transplantation, otherwise anemia, splenomegaly, and severe bone deformities occur. Patients with thalassemia intermedia may require blood transfusions depending on the severity of the disease.

SUMMARY OF THE INVENTION

Aspects of the invention disclosed herein provide methods and compositions that are useful for upregulating hemoglobin genes (HBB, HBD, HBE1, HBG1, and/or HBG2) in cells. In some embodiments, single stranded oligonucleotides are provided that target a PRC2-associated region of a hemoglobin gene (e.g., human HBB, human HBD, human HBE1, human HBG1, human HBG2) and thereby cause upregulation of the gene. In some embodiments, single stranded oligonucleotides are provided that target a PRC2-associated region of the gene encoding a hemoglobin gene. In some embodiments, these single stranded oligonucleotides activate or enhance expression of a hemoglobin gene by relieving or preventing PRC2 mediated repression of the hemoglobin gene.

Upregulation of hemoglobin subunits is provided as a treatment for anemia, sickle cell anemia and/or thalassemia. Aspects of the invention disclosed herein provide methods and compositions that are useful for upregulating a hemoglobin gene, e.g., HBB, HBD, HBE1, HBG1, and/or HBG2, for the treatment and/or prevention of sickle cell anemia or thalassemia. In certain aspects, the invention provides methods for upregulating HBE1, HBG1, and/or HBG2 for treatment and/or prevention of sickle cell anemia. In other aspects, the invention provides methods for upregulating HBB for treatment and/or prevention of beta-thalassemia. In certain aspects, the invention provides methods for upregulating HBD for treatment and/or prevention of delta-thalassemia.

Further aspects of the invention provide methods for selecting oligonucleotides for activating or enhancing expression of a hemoglobin gene, e.g., HBB, HBD, HBE1, HBG1 or HBG2. In some embodiments, methods are provided for selecting a set of oligonucleotides that is enriched in candidates (e.g., compared with a random selection of oligonucleotides) for activating or enhancing expression of a hemoglobin gene, e.g., HBB, HBD, HBE1, HBG1 or HBG2. Accordingly, the methods may be used to establish sets of clinical candidates that are enriched in oligonucleotides that activate or enhance expression of a hemoglobin gene, e.g., HBB, HBD, HBE1, HBG1 or HBG2. Such libraries may be utilized, for example, to identify lead oligonucleotides for developing therapeutics to treat a disease associated with decreased levels of a hemoglobin gene, e.g., HBB, HBD, HBE1, HBG1 or HBG2. Furthermore, in some embodiments, oligonucleotide chemistries are provided that are useful for controlling the pharmacokinetics, biodistribution, bioavailability and/or efficacy of the single stranded oligonucleotides for activating expression of a hemoglobin gene, e.g., HBB, HBD, HBE1, HBG1 or HBG2.

According to some aspects of the invention single stranded oligonucleotides are provided that have a region of complementarity that is complementarty with (e.g., at least 8 consecutive nucleotides of) a PRC2-associated region of a hemoglobin gene, e.g., a PRC2-associated region of the nucleotide sequence set forth as any one of SEQ ID NOS: 1-10. In some embodiments, the oligonucleotide has at least one of the following features: a) a sequence that is 5'X-Y-Z, in which X is any nucleotide and in which X is at the 5' end of the oligonucleotide, Y is a nucleotide sequence of 6 nucleotides in length that is not a human seed sequence of a microRNA, and Z is a nucleotide sequence of 1 to 23 nucleotides in length; b) a sequence that does not comprise three or more consecutive guanosine nucleotides; c) a sequence that has less than a threshold level of sequence identity with every sequence of nucleotides, of equivalent length to the second nucleotide sequence, that are between 50 kilobases upstream of a 5'-end of an off-target gene and 50 kilobases downstream of a 3'-end of the off-target gene; d) a sequence that is complementary to a PRC2-associated region that encodes an RNA that forms a secondary structure comprising at least two single stranded loops; and e) a sequence that has greater than 60% G-C content. In some embodiments, the single stranded oligonucleotide has at least two of features a), b), c), d), and e), each independently selected. In some embodiments, the single stranded oligonucleotide has at least three of features a), b), c), d), and e), each independently selected. In some embodiments, the single stranded oligonucleotide has at least four of features a), b), c), d), and e), each independently selected. In some embodiments, the single stranded oligonucleotide has each of features a), b), c), d), and e). In certain embodiments, the oligonucleotide has the sequence 5'X-Y-Z, in which the oligonucleotide is 8-50 nucleotides in length.

According to some aspects of the invention, single stranded oligonucleotides are provided that have a sequence X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with a PRC2-associated region of a hemoglobin gene, e.g., a PRC2-associated region of the nucleotide sequence set forth as any one of SEQ ID NOS: 1-10. In some aspects of the invention, single stranded oligonucleotides are provided that have a sequence 5'-X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with at least 8 consecutive nucleotides of a PRC2-associated region of a hemoglobin gene, e.g., a PRC2-associated region of the nucleotide sequence set forth as any one of SEQ ID NOS: 1-10. In some embodiments, Y is a sequence selected from Table 1. In some embodiments, the PRC2-associated region is a sequence listed in SEQ ID NO: 17 or 18.

In some embodiments, the single stranded oligonucleotide comprises a nucleotide sequence as set forth in any one of SEQ ID NOS: 19 to 3788 or 3797-3916, or a fragment thereof that is at least 8 nucleotides. In some embodiments, the single stranded oligonucleotide comprises a nucleotide sequence as set forth in any one of SEQ ID NOS: 19 to 3788 or 3797-3916, in which the 5' end of the nucleotide sequence provided is the 5' end of the oligonucleotide. In some embodiments, the region of complementarity (e.g., the at least 8 consecutive nucleotides) is also present within the nucleotide sequence set forth as any one of SEQ ID NOS: 11-16.

In some embodiments, the single stranded oligonucleotide comprises a nucleotide sequence as set forth in any one of SEQ ID NOS: 19 to 3788 or 3797-3916. In some embodiments, the oligonucleotide is up to 50 nucleotides in length. In some embodiments, the single stranded oligonucleotide comprises a fragment of at least 8 nucleotides of a nucleotide sequence as set forth in any one of SEQ ID NOS: 19 to 3788 or 3797-3916.

In some embodiments, the at least 8 consecutive nucleotides are also present within the nucleotide sequence set forth as SEQ ID NO: 11, 13, or 15. In some embodiments, the PRC2-associated region is a sequence listed in SEQ ID NO: 17 or 18. In some embodiments, the single stranded oligonucleotide comprises a nucleotide sequence as set forth in any one of SEQ ID NOS: 19-3788, 3820-3821, 3825-3826, or 3850-3916 or a fragment thereof that is at least 8 nucleotides.

In some embodiments, the at least 8 consecutive nucleotides are present within the nucleotide sequence set forth as SEQ ID NO: 12, 14, or 16. In some embodiments, the single stranded oligonucleotide comprises a nucleotide sequence as set forth in any one of SEQ ID NOS: 3797-3819, 3822-3824, or 3827-3849 or a fragment thereof that is at least 8 nucleotides.

In some embodiments, a single stranded oligonucleotide comprises a nucleotide sequence as set forth in Table 3. In some embodiments, the single stranded oligonucleotide comprises a fragment of at least 8 nucleotides of a nucleotide sequence as set forth in Table 3. In some embodiments, a single stranded oligonucleotide consists of a nucleotide sequence as set forth in Table 3.

In some embodiments, the single stranded oligonucleotide does not comprise three or more consecutive guanosine nucleotides. In some embodiments, the single stranded oligonucleotide does not comprise four or more consecutive guanosine nucleotides.

In some embodiments, the single stranded oligonucleotide is 8 to 30 nucleotides in length. In some embodiments, the single stranded oligonucleotide is up to 50 nucleotides in length. In some embodiments, the single stranded oligonucleotide is 8 to 10 nucleotides in length and all but 1, 2, or 3 of the nucleotides of the complementary sequence of the PRC2-associated region are cytosine or guanosine nucleotides.

In some embodiments, the single stranded oligonucleotide is complementary with at least 8 consecutive nucleotides of a PRC2-associated region of a hemoglobin gene, e.g., a PRC2 region of a nucleotide sequence set forth as any one of SEQ ID NOS: 1-10, in which the nucleotide sequence of the single stranded oligonucleotide comprises one or more of a nucleotide sequence selected from the group consisting of (a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx,
(X)XxxxxX, (X)xXXxxx, (X)xXxXxx, (X)xXxxXx,
(X)xXxxxX, (X)xxXXxx, (X)xxXxXx, (X)xxXxxX,
(X)xxxXXx, (X)xxxXxX and (X)xxxxXX, (c) (X)XXXxxx, (X)xXXXxx, (X)xxXXXx,
(X)xxxXXX, (X)XXxXxx, (X)XxxXxX, (X)XXxxxX,
(X)xXXxXx, (X)xXXxxX, (X)xxXXxX, (X)XxXXxx,
(X)XxxXXx (X)XxxxXX, (X)xXxxXx, (X)xXxxxX,
(X)xxXxXX, (X)xXxXxX and (X)XxXxXx, (d) (X)xxXXX, (X)xXxXXX, (X)xXXxXX,
(X)xXXXxX, (X)xXXXXx, (X)XxxXXXX,
(X)XxXxXX, (X)XxXXxX, (X)XxXXXx, (X)XXxxXX,
(X)XXxXxX, (X)XXxXXx, (X)XXXxxX,
(X)XXXxXx, and (X)XXXXxx, (e) (X)xXXXXX, (X)XxXXXX, (X)XXxXXX,
(X)XXXxXX, (X)XXXXxX and (X)XXXXXx, and (f) XXXXXX, XxXXXXX, XXxXXXX, XXXxXXX,
XXXXxXX, XXXXXxX and XXXXXXx, wherein
"X" denotes a nucleotide analogue, (X) denotes an
optional nucleotide analogue, and "x" denotes a DNA
or RNA nucleotide unit.

In some embodiments, at least one nucleotide of the oligonucleotide is a nucleotide analogue. In some embodiments, the at least one nucleotide analogue results in an increase in Tm of the oligonucleotide in a range of 1 to 5° C. compared with an oligonucleotide that does not have the at least one nucleotide analogue.

In some embodiments, at least one nucleotide of the oligonucleotide comprises a 2' O-methyl. In some embodiments, each nucleotide of the oligonucleotide comprises a 2' O-methyl. In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide. In some embodiments, each nucleotide of the oligonucleotide is a LNA nucleotide.

In some embodiments, the nucleotides of the oligonucleotide comprise alternating deoxyribonucleotides and 2'-fluoro-deoxyribonucleotides. In some embodiments, the nucleotides of the oligonucleotide comprise alternating deoxyribonucleotides and 2'-O-methyl nucleotides. In some embodiments, the nucleotides of the oligonucleotide comprise alternating deoxyribonucleotides and ENA nucleotide analogues. In some embodiments, the nucleotides of the oligonucleotide comprise alternating deoxyribonucleotides and LNA nucleotides. In some embodiments, the 5' nucleotide of the oligonucleotide is a deoxyribonucleotide. In some embodiments, the nucleotides of the oligonucleotide comprise alternating LNA nucleotides and 2'-O-methyl nucleotides. In some embodiments, the 5' nucleotide of the oligonucleotide is a LNA nucleotide. In some embodiments, the nucleotides of the oligonucleotide comprise deoxyribonucleotides flanked by at least one LNA nucleotide on each of the 5' and 3' ends of the deoxyribonucleotides.

In some embodiments, the single stranded oligonucleotide comprises modified internucleotide linkages (e.g., phosphorothioate internucleotide linkages or other linkages) between at least two, at least three, at least four, at least five or more nucleotides. In some embodiments, the single stranded oligonucleotide comprises modified internucleotide linkages (e.g., phosphorothioate internucleotide linkages or other linkages) between between all nucleotides.

In some embodiments, the nucleotide at the 3' position of the oligonucleotide has a 3' hydroxyl group. In some embodiments, the nucleotide at the 3' position of the oligonucleotide has a 3' thiophosphate. In some embodiments, the single stranded oligonucleotide has a biotin moiety or other moiety conjugated to its 5' or 3' nucleotide. In some embodiments, the single stranded oligonucleotide has cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

According to some aspects of the invention compositions are provided that comprise any of the oligonucleotides disclosed herein, and a carrier. In some embodiments, compositions are provided that comprise any of the oligonucleotides in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to other aspects of the invention, kits are provided that comprise a container housing any of the compositions disclosed herein.

According to some aspects of the invention, methods of increasing expression of HBB, HBD, HBE1, HBG1 or HBG2 in a cell are provided. In some embodiments, the methods involve delivering any one or more of the single stranded oligonucleotides disclosed herein into the cell. In some embodiments, delivery of the single stranded oligonucleotide into the cell results in a level of expression of HBB, HBD, HBE1, HBG1 or HBG2 that is greater (e.g., at least 50% greater) than a level of expression of HBB, HBD, HBE1, HBG1 or HBG2 in a control cell that does not comprise the single stranded oligonucleotide.

According to some aspects of the invention, methods of increasing levels of HBB, HBD, HBE1, HBG1 or HBG2 in a subject are provided. According to some aspects of the invention, methods of treating a condition (e.g., anemia, sickle cell anemia, thalassemia) associated with decreased levels of HBB, HBD, HBE1, HBG1 or HBG2 in a subject are provided. In some embodiments, the methods involve administering any one or more of the single stranded oligonucleotides disclosed herein to the subject.

BRIEF DESCRIPTION OF TABLES

Table 1: Hexamers that are not seed sequences of human miRNAs.

Table 2: A listing of oligonucleotide modifications.

Table 3: Formatted oligonucleotide sequences made for testing showing nucleotide modifications. The table shows the sequence of the modified nucleotides, where lnaX represents an LNA nucleotide with 3' phosphorothioate linkage, omeX is a 2'-O-methyl nucleotide, dX is a deoxy nucleotide. An s at the end of a nucleotide code indicates that the nucleotide had a 3' phosphorothioate linkage. The "-Sup" at the end of the sequence marks the fact that the 3' end lacks either a phosphate or thiophosphate on the 3' linkage. The Formatted Sequence column shows the sequence of the oligonucleotide, including modified nucleotides.

DETAILED DESCRIPTION OF CERTAIN
EMBODIMENTS OF THE INVENTION

Aspects of the invention provided herein relate to the discovery of polycomb repressive complex 2 (PRC2)-interacting RNAs. Polycomb repressive complex 2 (PRC2) is a histone methyltransferase and a known epigenetic regulator involved in silencing of genomic regions through methylation of histone H3. Among other functions, PRC2 interacts with long noncoding RNAs (lncRNAs), such as RepA, Xist, and Tsix, to catalyze trimethylation of histone H3-lysine27. PRC2 contains four subunits, Eed, Suz12, RbAp48, and Ezh2. Aspects of the invention relate to the recognition that single stranded oligonucleotides that bind to PRC2-associated regions of RNAs (e.g., lncRNAs) that are expressed from within a genomic region that encompasses or that is in functional proximity to the HBB, HBD, HBE1, HBG1 or HBG2 gene can induce or enhance expression of HBB, HBD, HBE1, HBG1 or HBG2. In some embodiments, this upregulation is believed to result from inhibition of PRC2 mediated repression of HBB, HBD, HBE1, HBG1 or HBG2.

As used herein, the term "PRC2-associated region" refers to a region of a nucleic acid that comprises or encodes a sequence of nucleotides that interact directly or indirectly with a component of PRC2. A PRC2-associated region may be present in a RNA (e.g., a long non-coding RNA (lncRNA)) that that interacts with a PRC2. A PRC2-associated region may be present in a DNA that encodes an RNA that interacts with PRC2. In some cases, the PRC2-associated region is equivalently referred to as a PRC2-interacting region.

In some embodiments, a PRC2-associated region is a region of an RNA that crosslinks to a component of PRC2 in response to in situ ultraviolet irradiation of a cell that expresses the RNA, or a region of genomic DNA that encodes that RNA region. In some embodiments, a PRC2-associated region is a region of an RNA that immunoprecipitates with an antibody that targets a component of PRC2, or a region of genomic DNA that encodes that RNA region. In some embodiments, a PRC2-associated region is a region of an RNA that immunoprecipitates with an antibody that binds specifically to SUZ12, EED, EZH2 or RBBP4 (which as noted above are components of PRC2), or a region of genomic DNA that encodes that RNA region.

In some embodiments, a PRC2-associated region is a region of an RNA that is protected from nucleases (e.g., RNases) in an RNA-immunoprecipitation assay that employs an antibody that targets a component of PRC2, or a region of genomic DNA that encodes that protected RNA region. In some embodiments, a PRC2-associated region is a region of an RNA that is protected from nucleases (e.g., RNases) in an RNA-immunoprecipitation assay that employs an antibody that targets SUZ12, EED, EZH2 or RBBP4, or a region of genomic DNA that encodes that protected RNA region.

In some embodiments, a PRC2-associated region is a region of an RNA within which occur a relatively high frequency of sequence reads in a sequencing reaction of products of an RNA-immunoprecipitation assay that employs an antibody that targets a component of PRC2, or a region of genomic DNA that encodes that RNA region. In some embodiments, a PRC2-associated region is a region of an RNA within which occur a relatively high frequency of sequence reads in a sequencing reaction of products of an RNA-immunoprecipitation assay that employs an antibody that binds specifically to SUZ12, EED, EZH2 or RBBP4, or a region of genomic DNA that encodes that protected RNA region. In such embodiments, the PRC2-associated region may be referred to as a "peak."

In some embodiments, a PRC2-associated region comprises a sequence of 40 to 60 nucleotides that interact with PRC2 complex. In some embodiments, a PRC2-associated region comprises a sequence of 40 to 60 nucleotides that encode an RNA that interacts with PRC2. In some embodiments, a PRC2-associated region comprises a sequence of up to 5 kb in length that comprises a sequence (e.g., of 40 to 60 nucleotides) that interacts with PRC2. In some embodiments, a PRC2-associated region comprises a sequence of up to 5 kb in length within which an RNA is encoded that has a sequence (e.g., of 40 to 60 nucleotides) that is known to interact with PRC2. In some embodiments, a PRC2-associated region comprises a sequence of about 4 kb in length that comprise a sequence (e.g., of 40 to 60 nucleotides) that interacts with PRC2. In some embodiments, a PRC2-associated region comprises a sequence of about 4 kb in length within which an RNA is encoded that includes a sequence (e.g., of 40 to 60 nucleotides) that is known to interact with PRC2. In some embodiments, a PRC2-associated region has a sequence as set forth in SEQ ID NO: 17 or 18.

In some embodiments, single stranded oligonucleotides are provided that specifically bind to, or are complementary to, a PRC2-associated region in a genomic region that encompasses or that is in proximity to the HBB, HBD, HBE1, HBG1 or HBG2 gene. In some embodiments, single stranded oligonucleotides are provided that specifically bind to, or are complementary to, a PRC2-associated region that has a sequence as set forth in SEQ ID NO: 17 or 18. In some embodiments, single stranded oligonucleotides are provided that specifically bind to, or are complementary to, a PRC2-associated region that has a sequence as set forth in SEQ ID NO: 17 or 18 combined with up to 2 kb, up to 5 kb, or up to 10 kb of flanking sequences from a corresponding genomic region to which these SEQ IDs map (e.g., in a human genome). In some embodiments, single stranded oligonucleotides have a sequence as set forth in any one of SEQ ID NOS: 19 to 3788 or 3797-3916. In some embodiments, a single stranded oligonucleotide has a sequence as set forth in Table 3.

Without being bound by a theory of invention, these oligonucleotides are able to interfere with the binding of and function of PRC2, by preventing recruitment of PRC2 to a specific chromosomal locus. For example, a single administration of single stranded oligonucleotides designed to specifically bind a PRC2-associated region lncRNA can stably displace not only the lncRNA, but also the PRC2 that binds to the lncRNA, from binding chromatin. After displacement, the full complement of PRC2 is not recovered for up to 24 hours. Further, lncRNA can recruit PRC2 in a cis fashion, repressing gene expression at or near the specific chromosomal locus from which the lncRNA was transcribed.

Methods of modulating gene expression are provided, in some embodiments, that may be carried out in vitro, ex vivo, or in vivo. It is understood that any reference to uses of compounds throughout the description contemplates use of the compound in preparation of a pharmaceutical composition or medicament for use in the treatment of condition (e.g., anemia, sickle cell anemia, thalassemia) associated with decreased levels or activity of HBB, HBD, HBE1, HBG1 or HBG2. Thus, as one nonlimiting example, this aspect of the invention includes use of such single stranded oligonucleotides in the preparation of a medicament for use in the treatment of disease, wherein the treatment involves upregulating expression of HBB, HBD, HBE1, HBG1 or HBG2.

In further aspects of the invention, methods are provided for selecting a candidate oligonucleotide for activating expression of HBB, HBD, HBE1, HBG1 or HBG2. The methods generally involve selecting as a candidate oligonucleotide, a single stranded oligonucleotide comprising a nucleotide sequence that is complementary to a PRC2- associated region (e.g., a nucleotide sequence as set forth in SEQ ID NO: 17 or 18). In some embodiments, sets of oligonucleotides may be selected that are enriched (e.g., compared with a random selection of oligonucleotides) in oligonucleotides that activate expression of HBB, HBD, HBE1, HBG1 or HBG2.

Single Stranded Oligonucleotides for Modulating Expression of HBB, HBD, HBE1, HBG1 or HBG2

In one aspect of the invention, single stranded oligonucleotides complementary to the PRC2-associated regions are provided for modulating expression of HBB, HBD, HBE1, HBG1 or HBG2 in a cell. In some embodiments, expression of HBB, HBD, HBE1, HBG1 or HBG2 is upregulated or increased. In some embodiments, single stranded oligonucleotides complementary to these PRC2-associated regions inhibit the interaction of PRC2 with long RNA transcripts such that gene expression is upregulated or increased. In some embodiments, single stranded oligonucleotides complementary to these PRC2-associated regions inhibit the interaction of PRC2 with long RNA transcripts, resulting in reduced methylation of histone H3 and reduced gene inactivation, such that gene expression is upregulated or increased. In some embodiments, this interaction may be disrupted or inhibited due to a change in the structure of the long RNA that prevents or reduces binding to PRC2. The oligonucleotide may be selected using any of the methods disclosed herein for selecting a candidate oligonucleotide for activating expression of HBB, HBD, HBE1, HBG1 or HBG2.

The single stranded oligonucleotide may comprise a region of complementarity that is complementary with a PRC2-associated region of a nucleotide sequence set forth in any one of SEQ ID NOS: 1 to 16. The region of complementarity of the single stranded oligonucleotide may be complementary with at least 6, e.g., at least 7, at least 8, at least 9, at least 10, at least 15 or more consecutive nucleotides of the PRC2-associated region.

The PRC2-associated region may map to a position in a chromosome between 50 kilobases upstream of a 5'-end of the HBB, HBD, HBE1, HBG1 or HBG2 gene and 50 kilobases downstream of a 3'-end of the HBB, HBD, HBE1, HBG1 or HBG2 gene. The PRC2-associated region may map to a position in a chromosome between 25 kilobases upstream of a 5'-end of the HBB, HBD, HBE1, HBG1 or HBG2 gene and 25 kilobases downstream of a 3'-end of the HBB, HBD, HBE1, HBG1 or HBG2 gene. The PRC2-associated region may map to a position in a chromosome between 12 kilobases upstream of a 5'-end of the HBB, HBD, HBE1, HBG1 or HBG2 gene and 12 kilobases downstream of a 3'-end of the HBB, HBD, HBE1, HBG1 or HBG2 gene. The PRC2-associated region may map to a position in a chromosome between 5 kilobases upstream of a 5'-end of the HBB, HBD, HBE1, HBG1 or HBG2 gene and 5 kilobases downstream of a 3'-end of the HBB, HBD, HBE1, HBG1 or HBG2 gene.

The genomic position of the selected PRC2-associated region relative to the HBB, HBD, HBE1, HBG1 or HBG2 gene may vary. For example, the PRC2-associated region may be upstream of the 5' end of the HBB, HBD, HBE1, HBG1 or HBG2 gene. The PRC2-associated region may be downstream of the 3' end of the HBB, HBD, HBE1, HBG1 or HBG2 gene. The PRC2-associated region may be within an intron of the HBB, HBD, HBE1, HBG1 or HBG2 gene. The PRC2-associated region may be within an exon of the HBB, HBD, HBE1, HBG1 or HBG2 gene. The PRC2-associated region may traverse an intron-exon junction, a 5'-UTR-exon junction or a 3'-UTR-exon junction of the HBB, HBD, HBE1, HBG1 or HBG2 gene.

The single stranded oligonucleotide may comprise a sequence having the formula X-Y-Z, in which X is any nucleotide, Y is a nucleotide sequence of 6 nucleotides in length that is not a human seed sequence of a microRNA, and Z is a nucleotide sequence of varying length. In some embodiments X is the 5' nucleotide of the oligonucleotide. In some embodiments, when X is anchored at the 5' end of the oligonucleotide, the oligonucleotide does not have any nucleotides or nucleotide analogs linked 5' to X. In some embodiments, other compounds such as peptides or sterols may be linked at the 5' end in this embodiment as long as they are not nucleotides or nucleotide analogs. In some embodiments, the single stranded oligonucleotide has a sequence 5'X-Y-Z and is 8-50 nucleotides in length. Oligonucleotides that have these sequence characteristics are predicted to avoid the miRNA pathway. Therefore, in some embodiments, oligonucleotides having these sequence characteristics are unlikely to have an unintended consequence of functioning in a cell as a miRNA molecule. The Y sequence may be a nucleotide sequence of 6 nucleotides in length set forth in Table 1.

The single stranded oligonucleotide may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The single stranded oligonucleotide may have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than HBB, HBD, HBE1, HBG1 or HBG2. In a similar embodiment, an oligonucleotide may be designed to ensure that it does not have a sequence that maps to any other known PRC2-associated region, particularly PRC2-associated regions that are functionally related to any other known gene (e.g., any other known protein coding gene). In either case, the oligonucleotide is expected to have a reduced likelihood of having off-target effects. The threshold level of sequence identity may be 50%, 60%, 70%, 80%, 85%, 90%, 95%, 99% or 100% sequence identity.

The single stranded oligonucleotide may have a sequence that is complementary to a PRC2-associated region that encodes an RNA that forms a secondary structure comprising at least two single stranded loops. In has been discovered that, in some embodiments, oligonucleotides that are complementary to a PRC2-associated region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the region of complementarity between the oligonucleotide and the PRC2-associated region may be at a location of the PRC2 associated region that encodes at least a portion of at least one of the loops. In some cases, the region of complementarity between the oligonucleotide and the PRC2-associated region may be at a location of the PRC2-associated region that encodes at least a portion of at least two of the loops. In some cases, the region of complementarity between the oligonucleotide and the PRC2-associated region may be at a location of the PRC2 associated region that encodes at least a portion of the double stranded stem. In some embodiments, a PRC2-associated region (e.g., of an lncRNA) is identified (e.g., using RIP-Seq methodology or information derived therefrom). In some embodiments, the predicted secondary structure RNA (e.g., lncRNA) containing the PRC2-associated region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The single stranded oligonucleotide may have a sequence that is has greater than 30% G-C content, greater than 40% G-C content, greater than 50% G-C content, greater than 60% G-C content, greater than 70% G-C content, or greater than 80% G-C content. The single stranded oligonucleotide may have a sequence that has up to 100% G-C content, up to 95% G-C content, up to 90% G-C content, or up to 80% G-C content. In some embodiments in which the oligonucleotide is 8 to 10 nucleotides in length, all but 1, 2, 3, 4, or 5 of the nucleotides of the complementary sequence of the PRC2-associated region are cytosine or guanosine nucleotides. In some embodiments, the sequence of the PRC2-associated region to which the single stranded oligonucleotide is complementary comprises no more than 3 nucleotides selected from adenine and uracil.

The single stranded oligonucleotide may be complementary to a chromosome of a different species (e.g., a mouse, rat, rabbit, goat, monkey, etc.) at a position that encompasses or that is in proximity to that species' homolog of HBB, HBD, HBE1, HBG1 or HBG2. The single stranded oligonucleotide may be complementary to a human genomic region encompassing or in proximity to the HBB, HBD, HBE1, HBG1 or HBG2 gene and also be complementary to a mouse genomic region encompassing or in proximity to the mouse homolog of HBB, HBD, HBE1, HBG1 or HBG2. For example, the single stranded oligonucleotide may be complementary to a sequence as set forth as any one of SEQ ID NOS: 1-10, which is a human genomic region encompassing or in proximity to the HBB, HBD, HBE1, HBG1 or HBG2 gene, and also be complementary to a sequence as set forth in any one of SEQ ID NOS: 1-10, which is a mouse genomic region encompassing or in proximity to the mouse homolog of the HBB, HBD, HBE1, HBG1 or HBG2 gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the single stranded oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a PRC2-associated region. In some embodiments, the region of complementarity is complementary with at least 8 consecutive nucleotides of a PRC2-associated region. In some embodiments the sequence of the single stranded oligonucleotide is based on an RNA sequence that binds to PRC2, or a portion thereof, said portion having a length of from 5 to 40 contiguous base pairs, or about 8 to 40 bases, or about 5 to 15, or about 5 to 30, or about 5 to 40 bases, or about 5 to 50 bases.

Complementary, as the term is used in the art, refers to the capacity for precise pairing between two nucleotides. For example, if a nucleotide at a certain position of an oligonucleotide is capable of hydrogen bonding with a nucleotide at the same position of PRC2-associated region, then the single stranded nucleotide and PRC2-associated region are considered to be complementary to each other at that position. The single stranded nucleotide and PRC2-associated region are complementary to each other when a sufficient number of corresponding positions in each molecule are occupied by nucleotides that can hydrogen bond with each other through their bases. Thus, "complementary" is a term which is used to indicate a sufficient degree of complementarity or precise pairing such that stable and specific binding occurs between the single stranded nucleotide and PRC2-associated region. For example, if a base at one position of a single stranded nucleotide is capable of hydrogen bonding with a base at the corresponding position of a PRC2-associated region, then the bases are considered to be complementary to each other at that position. 100% complementarity is not required.

The single stranded oligonucleotide may be at least 80% complementary to (optionally one of at least 85%, 90%, 91%, 92%, 93%, 94%, 95%, 96%, 97%, 98%, 99% or 100% complementary to) the consecutive nucleotides of a PRC2-associated region. In some embodiments the single stranded oligonucleotide may contain 1, 2 or 3 base mismatches compared to the portion of the consecutive nucleotides of a PRC2-associated region. In some embodiments the single stranded oligonucleotide may have up to 3 mismatches over 15 bases, or up to 2 mismatches over 10 bases.

It is understood in the art that a complementary nucleotide sequence need not be 100% complementary to that of its target to be specifically hybridizable. In some embodiments, a complementary nucleic acid sequence for purposes of the present disclosure is specifically hybridizable when binding of the sequence to the target molecule (e.g., lncRNA) interferes with the normal function of the target (e.g., lncRNA) to cause a loss of activity (e.g., inhibiting PRC2-associated repression with consequent up-regulation of gene expression) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency.

In some embodiments, the single stranded oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In a preferred embodiment, the oligonucleotide is 8 to 30 nucleotides in length.

In some embodiments, the PRC2-associated region occurs on the same DNA strand as a gene sequence (sense). In some embodiments, the PRC2-associated region occurs on the opposite DNA strand as a gene sequence (anti-sense). Oligonucleotides complementary to a PRC2-associated region can bind either sense or anti-sense sequences. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

In some embodiments, any one or more thymidine (T) nucleotides (or modified nucleotide thereof) or uridine (U) nucleotides (or a modified nucleotide thereof) in a sequence provided herein, including a sequence provided in the sequence listing, may be replaced with any other nucleotide suitable for base pairing (e.g., via a Watson-Crick base pair) with an adenosine nucleotide. In some embodiments, any one or more thymidine (T) nucleotides (or modified nucleotide thereof) or uridine (U) nucleotides (or a modified nucleotide thereof) in a sequence provided herein, including a sequence provided in the sequence listing, may be suitably replaced with a different pyrimidine nucleotide or vice versa. In some embodiments, any one or more thymidine (T) nucleotides (or modified nucleotide thereof) in a sequence provided herein, including a sequence provided in the sequence listing, may be suitably replaced with a uridine (U) nucleotide (or a modified nucleotide thereof) or vice versa.

In some embodiments, GC content of the single stranded oligonucleotide is preferably between about 30-60%. Contiguous runs of three or more Gs or Cs may not be preferable in some embodiments. Accordingly, in some embodiments, the oligonucleotide does not comprise a stretch of three or more guanosine nucleotides.

In some embodiments, the single stranded oligonucleotide specifically binds to, or is complementary to an RNA that is encoded in a genome (e.g., a human genome) as a single contiguous transcript (e.g., a non-spliced RNA). In some embodiments, the single stranded oligonucleotide specifically binds to, or is complementary to an RNA that is encoded in a genome (e.g., a human genome), in which the distance in the genome between the 5' end of the coding region of the RNA and the 3' end of the coding region of the RNA is less than 1 kb, less than 2 kb, less than 3 kb, less than 4 kb, less than 5 kb, less than 7 kb, less than 8 kb, less than 9 kb, less than 10 kb, or less than 20 kb.

It is to be understood that any oligonucleotide provided herein can be excluded. In some embodiments, a single stranded oligonucleotide is not complementary to SEQ ID NO: 3917.

In some embodiments, it has been found that single stranded oligonucleotides disclosed herein may increase expression of mRNA corresponding to the gene by at least about 50% (i.e. 150% of normal or 1.5 fold), or by about 2 fold to about 5 fold. In some embodiments, expression may be increased by at least about 15 fold, 20 fold, 30 fold, 40 fold, 50 fold or 100 fold, or any range between any of the foregoing numbers. It has also been found that increased mRNA expression has been shown to correlate to increased protein expression.

In some or any of the embodiments of the oligonucleotides described herein, or processes for designing or synthesizing them, the oligonucleotides will upregulate gene expression and may specifically bind or specifically hybridize or be complementary to the PRC2 binding RNA that is transcribed from the same strand as a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding sense strand of a reference gene (refGene).

In some or any of the embodiments of oligonucleotides described herein, or processes for designing or synthesizing them, the oligonucleotides will upregulate gene expression and may specifically bind or specifically hybridize or be complementary to a PRC2 binding RNA that transcribed from the opposite strand (the antisense strand) of a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding antisense strand of a reference gene The oligonucleotides described herein may be modified, e.g., comprise a modified sugar moiety, a modified internucleoside linkage, a modified nucleotide and/or combinations thereof. In addition, the oligonucleotides can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3 lysine27 methylation and/or do upregulate gene expression.

Oligonucleotides that are designed to interact with RNA to modulate gene expression are a distinct subset of base sequences from those that are designed to bind a DNA target (e.g., are complementary to the underlying genomic DNA sequence from which the RNA is transcribed).

Any of the oligonucleotides disclosed herein may be linked to one or more other oligonucleotides disclosed herein by a linker, e.g., a cleavable linker.

Method for Selecting Candidate Oligonucleotides for Activating Expression of Hemoglobin Genes Methods are provided herein for selecting a candidate oligonucleotide for activating or enhancing expression of HBB, HBD, HBE1, HBG1 or HBG2. The target selection methods may generally involve steps for selecting single stranded oligonucleotides having any of the structural and functional characteristics disclosed herein. Typically, the methods involve one or more steps aimed at identifying oligonucleotides that target a PRC2-associated region that is functionally related to HBB, HBD, HBE1, HBG1 or HBG2, for example a PRC2-associated region of a lncRNA that regulates expression of HBB, HBD, HBE1, HBG1 or HBG2 by facilitating (e.g., in a cis-regulatory manner) the recruitment of PRC2 to the HBB, HBD, HBE1, HBG1 or HBG2 gene. Such oligonucleotides are expected to be candidates for activating expression of HBB, HBD, HBE1, HBG1 or HBG2 because of their ability to hybridize with the PRC2-associated region of a nucleic acid (e.g., a lncRNA). This hybridization event is likely to disrupt interaction of PRC2 with the nucleic acid (e.g., a lncRNA) and as a result disrupt recruitment of PRC2 and its associated co-repressors (e.g., chromatin remodeling factors) to the HBB, HBD, HBE1, HBG1 or HBG2 gene locus.

Methods of selecting a candidate oligonucleotide may involve selecting a PRC2-associated region (e.g., a nucleotide sequence as set forth in SEQ ID NO: 17 or 18) that maps to a chromosomal position encompassing or in proximity to the HBB, HBD, HBE1, HBG1 or HBG2 gene (e.g., a chromosomal position having a sequence as set forth in any one of SEQ ID NOS: 1 to 16). The PRC2-associated region may map to the strand of the chromosome comprising the sense strand of the HBB, HBD, HBE1, HBG1 or HBG2 gene, in which case the candidate oligonucleotide is complementary to the sense strand of the HBB, HBD, HBE1, HBG1 or HBG2 gene (i.e., is antisense to the HBB, HBD, HBE1, HBG1 or HBG2 gene). Alternatively, the PRC2-associated region may map to the strand of the first chromosome comprising the antisense strand of the HBB, HBD, HBE1, HBG1 or HBG2 gene, in which case the oligonucleotide is complementary to the antisense strand (the template strand) of the HBB, HBD, HBE1, HBG1 or HBG2 gene (i.e., is sense to the HBB, HBD, HBE1, HBG1 or HBG2 gene).

Methods for selecting a set of candidate oligonucleotides that is enriched in oligonucleotides that activate expression of HBB, HBD, HBE1, HBG1 or HBG2 may involve selecting one or more PRC2-associated regions that map to a chromosomal position that encompasses or that is in proximity to the HBB, HBD, HBE1, HBG1 or HBG2 gene and selecting a set of oligonucleotides, in which each oligonucleotide in the set comprises a nucleotide sequence that is complementary with the one or more PRC2-associated regions. As used herein, the phrase, "a set of oligonucleotides that is enriched in oligonucleotides that activate expression of" refers to a set of oligonucleotides that has a greater number of oligonucleotides that activate expression of a target gene (e.g., HBB, HBD, HBE1, HBG1 or HBG2) compared with a random selection of oligonucleotides of the same physicochemical properties (e.g., the same GC content, $T_m$, length etc.) as the enriched set.

Where the design and/or synthesis of a single stranded oligonucleotide involves design and/or synthesis of a sequence that is complementary to a nucleic acid or PRC2-associated region described by such sequence information, the skilled person is readily able to determine the complementary sequence, e.g., through understanding of Watson Crick base pairing rules which form part of the common general knowledge in the field.

In some embodiments design and/or synthesis of a single stranded oligonucleotide involves manufacture of an oligonucleotide from starting materials by techniques known to those of skill in the art, where the synthesis may be based on a sequence of a PRC2-associated region, or portion thereof.

Methods of design and/or synthesis of a single stranded oligonucleotide may involve one or more of the steps of:

Identifying and/or selecting PRC2-associated region;

Designing a nucleic acid sequence having a desired degree of sequence identity or complementarity to a PRC2-associated region or a portion thereof;

Synthesizing a single stranded oligonucleotide to the designed sequence;

Purifying the synthesized single stranded oligonucleotide; and

Optionally mixing the synthesized single stranded oligonucleotide with at least one pharmaceutically acceptable diluent, carrier or excipient to form a pharmaceutical composition or medicament.

Single stranded oligonucleotides so designed and/or synthesized may be useful in method of modulating gene expression as described herein.

Preferably, single stranded oligonucleotides of the invention are synthesized chemically. Oligonucleotides used to practice this invention can be synthesized in vitro by well-known chemical synthesis techniques.

Oligonucleotides of the invention can be stabilized against nucleolytic degradation such as by the incorporation of a modification, e.g., a nucleotide modification. For example, nucleic acid sequences of the invention include a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O—NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom.

It is understood that any of the modified chemistries or formats of single stranded oligonucleotides described herein can be combined with each other, and that one, two, three, four, five, or more different types of modifications can be included within the same molecule.

In some embodiments, the method may further comprise the steps of amplifying the synthesized single stranded oligonucleotide, and/or purifying the single stranded oligonucleotide (or amplified single stranded oligonucleotide), and/or sequencing the single stranded oligonucleotide so obtained.

As such, the process of preparing a single stranded oligonucleotide may be a process that is for use in the manufacture of a pharmaceutical composition or medicament for use in the treatment of disease, optionally wherein the treatment involves modulating expression of a gene associated with a PRC2-associated region.

In the methods described above a PRC2-associated region may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

Where the single stranded oligonucleotide is based on a PRC2-associated region, or a portion of such a sequence, it may be based on information about that sequence, e.g., sequence information available in written or electronic form, which may include sequence information contained in publicly available scientific publications or sequence databases.

Nucleotide Analogues

In some embodiments, the oligonucleotide may comprise at least one ribonucleotide, at least one deoxyribonucleotide, and/or at least one bridged nucleotide. In some embodiments, the oligonucleotide may comprise a bridged nucleotide, such as a locked nucleic acid (LNA) nucleotide, a constrained ethyl (cEt) nucleotide, or an ethylene bridged nucleic acid (ENA) nucleotide. Examples of such nucleotides are disclosed herein and known in the art. In some embodiments, the oligonucleotide comprises a nucleotide analog disclosed in one of the following United States patent or patent application Publications: U.S. Pat. Nos. 7,399,845, 7,741,457, 8,022,193, 7,569,686, 7,335,765, 7,314,923, 7,335,765, and U.S. Pat. Nos. 7,816,333, US 20110009471, the entire contents of each of which are incorporated herein by reference for all purposes. The oligonucleotide may have one or more 2' O-methyl nucleotides. The oligonucleotide may consist entirely of 2' O-methyl nucleotides.

Often the single stranded oligonucleotide has one or more nucleotide analogues. For example, the single stranded oligonucleotide may have at least one nucleotide analogue that results in an increase in $T_m$ of the oligonucleotide in a range of 1° C., 2° C., 3° C., 4° C., or 5° C. compared with an oligonucleotide that does not have the at least one nucleotide analogue. The single stranded oligonucleotide may have a plurality of nucleotide analogues that results in a total increase in $T_m$ of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the nucleotide analogue.

The oligonucleotide may be of up to 50 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are nucleotide analogues. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are nucleotide analogues.

The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are nucleotide analogues. Optionally, the oligonucleotides may have every nucleotide except 1, 2, 3, 4, 5, 6, 7, 8, 9, or 10 nucleotides modified.

The oligonucleotide may consist entirely of bridged nucleotides (e.g., LNA nucleotides, cEt nucleotides, ENA nucleotides). The oligonucleotide may comprise alternating deoxyribonucleotides and 2'-fluoro-deoxyribonucleotides. The oligonucleotide may comprise alternating deoxyribonucleotides and 2'-O-methyl nucleotides. The oligonucleotide may comprise alternating deoxyribonucleotides and ENA nucleotide analogues. The oligonucleotide may comprise alternating deoxyribonucleotides and LNA nucleotides. The oligonucleotide may comprise alternating LNA nucleotides and 2'-O-methyl nucleotides. The oligonucleotide may have a 5' nucleotide that is a bridged nucleotide (e.g., a LNA nucleotide, cEt nucleotide, ENA nucleotide). The oligonucleotide may have a 5' nucleotide that is a deoxyribonucleotide.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. The 3' position of the oligonucleotide may have a 3' hydroxyl group. The 3' position of the oligonucleotide may have a 3' thiophosphate.

The oligonucleotide may be conjugated with a label. For example, the oligonucleotide may be conjugated with a biotin moiety, cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

Preferably the single stranded oligonucleotide comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the single stranded oligonucleotides are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric single stranded oligonucleotides of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the single stranded oligonucleotide comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, —N($CH_3$)—O—$CH_2$ (known as a methylene(methylimino) or MMI backbone, $CH_2$—O—N($CH_3$)—$CH_2$, $CH_2$—N($CH_3$)—N($CH_3$)—$CH_2$ and O—N($CH_3$)— $CH_2$—$CH_2$ backbones, wherein the native phosphodiester backbone is represented as O—P—O—$CH$,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-0,4'-C-ethylene-bridged nucleic acids.

Examples of LNAs are described in WO/2008/043753 and include compounds of the following general formula.

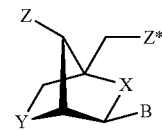

where X and Y are independently selected among the groups —O—,
—S—, —N(H)—, N(R)—, —CH$_2$— or —CH— (if part of a double bond),
—CH$_2$—O—, —CH$_2$—S—, —CH$_2$—N(H)—, —CH$_2$—N(R)—, —CH$_2$—CH$_2$— or —CH$_2$—CH— (if part of a double bond),
—CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligonucleotides described herein comprises at least one LNA unit according any of the formulas

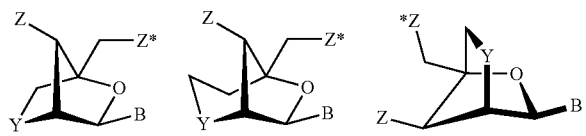

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

In some embodiments, the Locked Nucleic Acid (LNA) used in the oligonucleotides described herein comprises at least one Locked Nucleic Acid (LNA) unit according any of the formulas shown in Scheme 2 of PCT/DK2006/000512.

In some embodiments, the LNA used in the oligomer of the invention comprises internucleoside linkages selected from -0-P(O)$_2$—O—, —O—P(O,S)—O—, -0-P(S)$_2$—O—, —S—P(O)$_2$—O—, —S—P(O,S)—O—, —S—P(S)$_2$—O—, -0-P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—OC—O—, where R$^H$ is selected from hydrogen and C$_{1-4}$-alkyl.

Specifically preferred LNA units are shown in scheme 2:

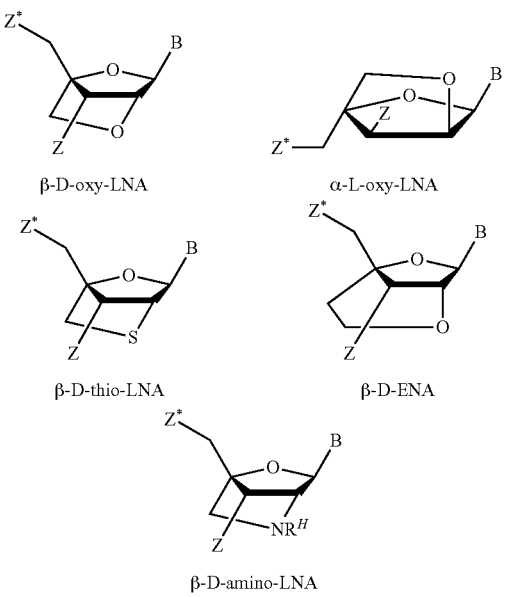

Scheme 2

β-D-oxy-LNA   α-L-oxy-LNA

β-D-thio-LNA   β-D-ENA

β-D-amino-LNA

The term "thio-LNA" comprises a locked nucleotide in which at least one of X or Y in the general formula above is selected from S or —CH$_2$—S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail herein.

One or more substituted sugar moieties can also be included, e.g., one of the following at the 2' position: OH, SH, SCH$_3$, F, OCN, OCH$_3$ OCH$_3$, OCH$_3$O(CH$_2$)n CH$_3$, O(CH$_2$)n NH$_2$ or O(CH$_2$)n CH$_3$ where n is from 1 to about 10; C1 to C10 lower alkyl, alkoxyalkoxy, substituted lower alkyl, alkaryl or aralkyl; Cl; Br; CN; CF$_3$; OCF$_3$; O—, S—, or N-alkyl; O—, S—, or N-alkenyl; SOCH$_3$; SO$_2$CH$_3$; ONO$_2$; NO$_2$, N$_3$; NH2; heterocycloalkyl; heterocycloalkaryl; amino alkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O—CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-O—CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Single stranded oligonucleotides can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino) adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2° C. (Sanghvi, in Crooke, and Lebleu, eds., Antisense Research and Applications, CRC Press, Boca Raton, 1993, pp. 276-278) and may be used as base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Single stranded oligonucleotides can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the single stranded oligonucleotides are chemically linked to one or more moieties or conjugates that enhance the activity, cellular distribution, or cellular uptake of the oligonucleotide. For example, one or more single stranded oligonucleotides, of the same or different types, can be conjugated to each other; or single stranded oligonucleotides can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

In some embodiments, single stranded oligonucleotide modification include modification of the 5' or 3' end of the oligonucleotide. In some embodiments, the 3' end of the oligonucleotide comprises a hydroxyl group or a thiophosphate. It should be appreciated that additional molecules (e.g. a biotin moiety or a fluorophor) can be conjugated to the 5' or 3' end of the single stranded oligonucleotide. In some embodiments, the single stranded oligonucleotide comprises a biotin moiety conjugated to the 5' nucleotide.

In some embodiments, the single stranded oligonucleotide comprises locked nucleic acids (LNA), ENA modified nucleotides, 2'-O-methyl nucleotides, or 2'-fluoro-deoxyribonucleotides. In some embodiments, the single stranded oligonucleotide comprises alternating deoxyribonucleotides and 2'-fluoro-deoxyribonucleotides. In some embodiments, the single stranded oligonucleotide comprises alternating deoxyribonucleotides and 2'-O-methyl nucleotides. In some embodiments, the single stranded oligonucleotide comprises alternating deoxyribonucleotides and ENA modified nucleotides. In some embodiments, the single stranded oligonucleotide comprises alternating deoxyribonucleotides and locked nucleic acid nucleotides. In some embodiments, the single stranded oligonucleotide comprises alternating locked nucleic acid nucleotides and 2'-O-methyl nucleotides.

In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the single stranded oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the single stranded oligonucleotide can have any combination of modifications as described herein.

The oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxxXXx, (X)XxxxXX, (X)xXxXXx, (X)xXxxXX, (X)xxXxXX, (X)xXxXxX and (X)XxXxXx, (d) (X)xxXXX, (X)xXxXXX, (X)xXXxXX, (X)xXXXxX, (X)xXXXXx, (X)XxxXXXX, (X)XxXxXX, (X)XxXXxX, (X)XxXXXx, (X)XXxxXX, (X)XXxXxX, (X)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

Methods for Modulating Gene Expression

In one aspect, the invention relates to methods for modulating gene expression in a cell (e.g., a cell for which HBB, HBD, HBE1, HBG1 or HBG2 levels are reduced) for research purposes (e.g., to study the function of the gene in the cell). In another aspect, the invention relates to methods for modulating gene expression in a cell (e.g., a cell for which HBB, HBD, HBE1, HBG1 or HBG2 levels are reduced) for gene or epigenetic therapy. The cells can be in vitro, ex vivo, or in vivo (e.g., in a subject who has a disease resulting from reduced expression or activity of HBB, HBD, HBE1, HBG1 or HBG2. In some embodiments, methods for modulating gene expression in a cell comprise delivering a single stranded oligonucleotide as described herein. In some embodiments, delivery of the single stranded oligonucleotide to the cell results in a level of expression of gene that is at least 5%, 10%, 20%, 30%, 40%, 50%, 60%, 70%, 80%, 90%, 100%, 200% or more greater than a level of expression of gene in a control cell to which the single stranded oligonucleotide has not been delivered. In certain embodiments, delivery of the single stranded oligonucleotide to the cell results in a level of expression of gene that is at least 50% greater than a level of expression of gene in a control cell to which the single stranded oligonucleotide has not been delivered.

In another aspect of the invention, methods comprise administering to a subject (e.g. a human) a composition comprising a single stranded oligonucleotide as described herein to increase protein levels in the subject. In some embodiments, the increase in protein levels is at least 5%, 10%, 20%, 30%, 40%, 50%, 60%, 70%, 80%, 90%, 100%, 200%, or more, higher than the amount of a protein in the subject before administering.

As another example, to increase expression of HBB, HBD, HBE1, HBG1 or HBG2 in a cell, the methods include introducing into the cell a single stranded oligonucleotide that is sufficiently complementary to a PRC2-associated region (e.g., of a long non-coding RNA) that maps to a genomic position encompassing or in proximity to the HBB, HBD, HBE1, HBG1 or HBG2 gene.

In another aspect of the invention provides methods of treating a condition (e.g., anemia, sickle cell anemia, thalassemia) associated with decreased levels of expression of HBB, HBD, HBE1, HBG1 or HBG2 in a subject, the method comprising administering a single stranded oligonucleotide as described herein.

A subject can include a non-human mammal, e.g. mouse, rat, guinea pig, rabbit, cat, dog, goat, cow, or horse. In preferred embodiments, a subject is a human. Single stranded oligonucleotides have been employed as therapeutic moieties in the treatment of disease states in animals, including humans. Single stranded oligonucleotides can be useful therapeutic modalities that can be configured to be useful in treatment regimes for the treatment of cells, tissues and animals, especially humans.

For therapeutics, an animal, preferably a human, suspected of having anemia, sickle cell anemia and/or thalassemia is treated by administering single stranded oligonucleotide in accordance with this invention. For example, in one non-limiting embodiment, the methods comprise the step of administering to the animal in need of treatment, a therapeutically effective amount of a single stranded oligonucleotide as described herein.

Formulation, Delivery, and Dosing

The oligonucleotides described herein can be formulated for administration to a subject for treating a condition (e.g., anemia, sickle cell anemia, thalassemia) associated with decreased levels of HBB, HBD, HBE1, HBG1 or HBG2. It should be understood that the formulations, compositions and methods can be practiced with any of the oligonucleotides disclosed herein.

The formulations may conveniently be presented in unit dosage form and may be prepared by any methods well known in the art of pharmacy. The amount of active ingredient (e.g., an oligonucleotide or compound of the invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g. tumor regression.

Pharmaceutical formulations of this invention can be prepared according to any method known to the art for the manufacture of pharmaceuticals. Such formulations can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

A formulated single stranded oligonucleotide composition can assume a variety of states. In some examples, the composition is at least partially crystalline, uniformly crystalline, and/or anhydrous (e.g., less than 80, 50, 30, 20, or 10% water). In another example, the single stranded oligonucleotide is in an aqueous phase, e.g., in a solution that includes water. The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the single stranded oligonucleotide composition is formulated in a manner that is compatible with the intended method of administration.

In some embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A single stranded oligonucleotide preparation can be formulated or administered (together or separately) in combination with another agent, e.g., another therapeutic agent or an agent that stabilizes a single stranded oligonucleotide, e.g., a protein that complexes with single stranded oligonucleotide. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the single stranded oligonucleotide preparation includes another single stranded oligonucleotide, e.g., a second single stranded oligonucleotide that modulates expression of a second gene or a second single stranded oligonucleotide that modulates expression of the first gene. Still other preparation can include at least 3, 5, ten, twenty, fifty, or a hundred or more different single stranded oligonucleotide species. Such single stranded oligonucleotides can mediated gene expression with respect to a similar number of different genes. In one embodiment, the single stranded oligonucleotide preparation includes at least a second therapeutic agent (e.g., an agent other than an oligonucleotide).

Route of Delivery

A composition that includes a single stranded oligonucleotide can be delivered to a subject by a variety of routes. Exemplary routes include: intravenous, intradermal, topical, rectal, parenteral, anal, intravaginal, intranasal, pulmonary, ocular. The term "therapeutically effective amount" is the amount of oligonucleotide present in the composition that is needed to provide the desired level of HBB, HBD, HBE1, HBG1 or HBG2 expression in the subject to be treated to give the anticipated physiological response. The term "physiologically effective amount" is that amount delivered to a subject to give the desired palliative or curative effect. The term "pharmaceutically acceptable carrier" means that the carrier can be administered to a subject with no significant adverse toxicological effects to the subject.

The single stranded oligonucleotide molecules of the invention can be incorporated into pharmaceutical compositions suitable for administration. Such compositions typically include one or more species of single stranded oligonucleotide and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the single stranded oligonucleotide in aerosol form. The vascular endothelial cells could be targeted by coating a balloon catheter with the single stranded oligonucleotide and mechanically introducing the oligonucleotide.

Topical administration refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy. In addition, iontophoresis (transfer of ionic solutes through biological membranes under the influence of an electric field), phonophoresis or sonophoresis (use of ultrasound to enhance the absorption of various therapeutic agents across biological membranes, notably the skin and the cornea), and optimization of vehicle characteristics relative to dose position and retention at the site of administration may be useful methods for enhancing the transport of topically applied compositions across skin and mucosal sites.

Both the oral and nasal membranes offer advantages over other routes of administration. For example, oligonucleotides administered through these membranes may have a rapid onset of action, provide therapeutic plasma levels, avoid first pass effect of hepatic metabolism, and avoid exposure of the oligonucleotides to the hostile gastrointestinal (GI) environment. Additional advantages include easy access to the membrane sites so that the oligonucleotide can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many agents. Further, the sublingual mucosa is convenient, acceptable and easily accessible.

A pharmaceutical composition of single stranded oligonucleotide may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Compositions for oral administration include powders or granules, suspensions or solutions in water, syrups, slurries, emulsions, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Parenteral administration includes intravenous drip, subcutaneous, intraperitoneal or intramuscular injection, intrathecal or intraventricular administration. In some embodiments, parental administration involves administration directly to the site of disease (e.g. injection into a tumor).

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

Any of the single stranded oligonucleotides described herein can be administered to ocular tissue. For example, the compositions can be applied to the surface of the eye or nearby tissue, e.g., the inside of the eyelid. For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers. The single stranded oligonucleotide can also be administered to the interior of the eye, and can be introduced by a needle or other delivery device which can introduce it to a selected area or structure.

Pulmonary delivery compositions can be delivered by inhalation by the patient of a dispersion so that the composition, preferably single stranded oligonucleotides, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self-contained. Dry powder dispersion devices, for example, deliver agents that may be readily formulated as dry powders. A single stranded oligonucleotide composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 μm in diameter preferably with a relatively uniform spheroidal shape distribution. More preferably the diameter is less than about 7.5 μm and most preferably less than about 5.0 μm. Usually the particle size distribution is between about 0.1 μm and about 5 μm in diameter, particularly about 0.3 μm to about 5 μm.

The term "dry" means that the composition has a moisture content below about 10% by weight (% w) water, usually below about 5% w and preferably less it than about 3% w.

A dry composition can be such that the particles are readily dispersible in an inhalation device to form an aerosol.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Suitable pH adjusters or buffers include organic salts prepared from organic acids and bases, such as sodium citrate, sodium ascorbate, and the like; sodium citrate is preferred. Pulmonary administration of a micellar single stranded oligonucleotide formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a single stranded oligonucleotide, e.g., a device can release insulin.

In one embodiment, unit doses or measured doses of a composition that includes single stranded oligonucleotide are dispensed by an implanted device. The device can include a sensor that monitors a parameter within a subject. For example, the device can include pump, e.g., and, optionally, associated electronics.

Tissue, e.g., cells or organs can be treated with a single stranded oligonucleotide, ex vivo and then administered or implanted in a subject. The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation. Introduction of treated tissue, whether autologous or transplant, can be combined with other therapies. In some implementations, the single stranded oligonucleotide treated cells are insulated from other cells, e.g., by a semi-permeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains a single stranded oligonucleotide. Exemplary devices include condoms, diaphragms, IUD (implantable uterine devices, sponges, vaginal sheaths, and birth control devices.

Dosage

In one aspect, the invention features a method of administering a single stranded oligonucleotide (e.g., as a compound or as a component of a composition) to a subject (e.g., a human subject). In one embodiment, the unit dose is between about 10 mg and 25 mg per kg of bodyweight. In one embodiment, the unit dose is between about 1 mg and 100 mg per kg of bodyweight. In one embodiment, the unit dose is between about 0.1 mg and 500 mg per kg of bodyweight. In some embodiments, the unit dose is more than 0.001, 0.005, 0.01, 0.05, 0.1, 0.5, 1, 2, 5, 10, 25, 50 or 100 mg per kg of bodyweight.

The defined amount can be an amount effective to treat or prevent a disease or disorder, e.g., a disease or disorder associated with the HBB, HBD, HBE1, HBG1 or HBG2. The unit dose, for example, can be administered by injection (e.g., intravenous or intramuscular), an inhaled dose, or a topical application.

In some embodiments, the unit dose is administered daily. In some embodiments, less frequently than once a day, e.g., less than every 2, 4, 8 or 30 days. In another embodiment, the unit dose is not administered with a frequency (e.g., not a regular frequency). For example, the unit dose may be administered a single time. In some embodiments, the unit dose is administered more than once a day, e.g., once an hour, two hours, four hours, eight hours, twelve hours, etc.

In one embodiment, a subject is administered an initial dose and one or more maintenance doses of a single stranded oligonucleotide. The maintenance dose or doses are generally lower than the initial dose, e.g., one-half less of the initial dose. A maintenance regimen can include treating the subject with a dose or doses ranging from 0.0001 to 100 mg/kg of body weight per day, e.g., 100, 10, 1, 0.1, 0.01, 0.001, or 0.0001 mg per kg of bodyweight per day. The maintenance doses may be administered no more than once every 1, 5, 10, or 30 days. Further, the treatment regimen may last for a period of time which will vary depending upon the nature of the particular disease, its severity and the overall condition of the patient. In some embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the oligonucleotide may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In some embodiments, the oligonucleotide pharmaceutical composition includes a plurality of single stranded oligonucleotide species. In another embodiment, the single stranded oligonucleotide species has sequences that are non-overlapping and non-adjacent to another species with respect to a naturally occurring target sequence (e.g., a PRC2-associated region). In another embodiment, the plurality of single stranded oligonucleotide species is specific for different PRC2-associated regions. In another embodiment, the single stranded oligonucleotide is allele specific. In some cases, a patient is treated with a single stranded oligonucleotide in conjunction with other therapeutic modalities.

Following successful treatment, it may be desirable to have the patient undergo maintenance therapy to prevent the recurrence of the disease state, wherein the compound of the invention is administered in maintenance doses, ranging from 0.0001 mg to 100 mg per kg of body weight.

The concentration of the single stranded oligonucleotide composition is an amount sufficient to be effective in treating or preventing a disorder or to regulate a physiological condition in humans. The concentration or amount of single stranded oligonucleotide administered will depend on the parameters determined for the agent and the method of administration, e.g. nasal, buccal, pulmonary. For example, nasal formulations may tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a single stranded oligonucleotide can include a single treatment or, preferably, can include a series of treatments. It will also be appreciated that the effective dosage of a single stranded oligonucleotide used for treatment may increase or decrease over the course of a particular treatment. For example, the subject can be monitored after administering a single stranded oligonucleotide composition. Based on information from the monitoring, an additional amount of the single stranded oligonucleotide composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of HBB, HBD, HBE1, HBG1 or HBG2 expression levels in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human HBB, HBD, HBE1, HBG1 or HBG2. In another embodiment, the composition for testing includes a single stranded oligonucleotide that is complementary, at least in an internal region, to a sequence that is conserved between HBB, HBD, HBE1, HBG1 or HBG2 in the animal model and the HBB, HBD, HBE1, HBG1 or HBG2 in a human.

In one embodiment, the administration of the single stranded oligonucleotide composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The composition can be provided in measured doses or in a dispenser which delivers a metered dose. Selected modes of delivery are discussed in more detail below.

Kits

In certain aspects of the invention, kits are provided, comprising a container housing a composition comprising a single stranded oligonucleotide. In some embodiments, the composition is a pharmaceutical composition comprising a single stranded oligonucleotide and a pharmaceutically acceptable carrier. In some embodiments, the individual components of the pharmaceutical composition may be provided in one container. Alternatively, it may be desirable to provide the components of the pharmaceutical composition separately in two or more containers, e.g., one container for single stranded oligonucleotides, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

The invention is further described in the following examples, which do not limit the scope of the invention described in the claims.
Materials and Methods:
Real Time PCR RNA is harvested from the cells using Promega SV 96 Total RNA Isolation system or Trizol omitting the DNAse step. RNA harvested from cells is normalized so that equal RNA is input to each reverse transcription reaction. Reverse transcriptase reactions are performed using the Superscript II kit and real time PCR performed on cDNA samples using icycler SYBR green chemistry (Biorad). A baseline level of mRNA expression for HBB, HBD, HBE1, HBG1 or HBG2 is determined through quantitative PCR as outlined above. Baseline levels are also determined for mRNA of various housekeeping genes which are constitutively expressed. A "control" housekeeping gene with approximately the same level of baseline expression as the target gene is chosen for comparison purposes.
Cell Culture Human hepatocyte Hep3B, human hepatocyte HepG2 cells, mouse hepatoma Hepa 1-6 cells, and human renal proximal tubule epithelial cells (RPTEC) are cultured using conditions known in the art (see, e.g. Current Protocols in Cell Biology).
Oligonucleotide Design Oligonucleotides were designed within PRC2-interacting regions in order to upregulate HBB or HBG2. The sequence and structure of each oligonucleotide is shown in Table 3. A description of the nucleotide analogs, modifications and intranucleotide linkages used for certain oligonucleotides described is provided in Table 2.

SEQ ID NOs: 3789 to 3796 are control oligos. SEQ ID NO: 3789 is a splice-altering oligo targeting a site in intron 2 of HBB. SEQ ID NOs: 3790-3793 are 15-mer subsequences of SEQ ID NO: 3789. SEQ ID NO: 3795 is a dimer of SEQ ID NO: 3789. SEQ ID NOs: 3794 and 3796 are a control oligo and a dimer version of the control oligo, respectively.
In Vitro Transfection of Cells with Oligonucleotides Oligonucleotides are designed within PRC2-interacting regions in order to upregulate HBB, HBD, HBE1, HBG1 or HBG2. Cells are seeded into each well of 24-well plates at a density of 25,000 cells per 500 uL and transfections are performed with Lipofectamine and the single stranded oligonucleotides. Control wells contain Lipofectamine alone. At 48 hours post-transfection, approximately 200 uL of cell culture supernatants are stored at −80 C for ELISA. At 48 hours post-transfection, RNA is harvested from the cells and quantitative PCR is carried out as outlined above. The percent induction of target mRNA expression by each oligonucleotide is determined by normalizing mRNA levels in the presence of the oligonucleotide to the mRNA levels in the presence of control (Lipofectamine alone). This is compared side-by-side with the increase in mRNA expression of the "control" housekeeping gene.

In Vitro Delivery of Single Stranded Oligonucleotides

Oligonucleotides are designed as candidates for upregulating HBB, HBD, HBE1, HBG1 or HBG2 expression. The single stranded oligonucleotides are designed to be complementary to a PRC2-interacting region within a sequence as set forth as any one of SEQ ID NOS: 1-10. The oligonucleotides are tested in at least duplicate. Briefly, cells are transfected in vitro with each of the oligonucleotides as described above. HBB, HBD, HBE1, HBG1 or HBG2 expression in cells following treatment is evaluated by qRT-PCR. Oligonucleotides that upregulate HBB, HBD, HBE1, HBG1 or HBG2 expression are identified.

TABLE 1

| Hexamers that are not seed sequences of human miRNAs |
|---|
| AAAAAA, AAAAAG, AAAACA, AAAAGA, AAAAGC, AAAAGG, AAAAUA, AAACAA, AAACAC, AAACAG, |
| AAACAU, AAACCC, AAACCU, AAACGA, AAACGC, AAACGU, AAACUA, AAACUC, AAACUU, AAAGAU, |
| AAAGCC, AAAGGA, AAAGGG, AAAGUC, AAAUAC, AAAUAU, AAAUCG, AAAUCU, AAAUGC, AAAUGU, |
| AAAUUA, AAAUUG, AACAAC, AACAAG, AACAAU, AACACA, AACACG, AACAGA, AACAGC, AACAGG, |
| AACAUC, AACAUG, AACCAA, AACCAC, AACCAG, AACCAU, AACCCC, AACCCG, AACCGA, AACCGC, |
| AACCGG, AACCUA, AACCUU, AACGAA, AACGAC, AACGAG, AACGAU, AACGCU, AACGGG, AACGGU, |
| AACGUA, AACGUC, AACGUG, AACGUU, AACUAU, AACUCA, AACUCC, AACUCG, AACUGA, AACUGC, |
| AACUGU, AACUUA, AACUUC, AACUUG, AACUUU, AAGAAA, AAGAAG, AAGAAU, AAGACG, AAGAGA, |
| AAGAGC, AAGAGG, AAGAGU, AAGAUU, AAGCAA, AAGCAC, AAGCAG, AAGCAU, AAGCCA, AAGCCC, |
| AAGCCG, AAGCCU, AAGCGA, AAGCGG, AAGCGU, AAGCUA, AAGGAA, AAGGAC, AAGGCU, AAGGGC, |
| AAGGGU, AAGGUU, AAGUAA, AAGUAC, AAGUAU, AAGUCC, AAGUCG, AAGUGA, AAGUGG, AAGUUA, |
| AAGUUU, AAUAAA, AAUAAC, AAUAAG, AAUAAU, AAUACA, AAUACC, AAUACG, AAUAGA, AAUAGC, |
| AAUAGG, AAUAGU, AAUAUC, AAUAUU, AAUCAA, AAUCAU, AAUCCA, AAUCCC, AAUCCG, AAUCGA, |
| AAUCGC, AAUCGU, AAUCUA, AAUCUG, AAUCUU, AAUGAA, AAUGAC, AAUGAG, AAUGAU, AAUGCG, |
| AAUGCU, AAUGGA, AAUGGU, AAUGUA, AAUGUC, AAUGUG, AAUUAA, AAUUAC, AAUUAG, AAUUCC, |
| AAUUCG, AAUUGA, AAUUGG, AAUUGU, AAUUUC, AAUUUG, ACAAAA, ACAAAC, ACAAAG, ACAAAU, |
| ACAACC, ACAACG, ACAACU, ACAAGA, ACAAGC, ACAAGU, ACAAUC, ACAAUG, ACAAUU, ACACAG, |
| ACACCA, ACACCC, ACACCG, ACACCU, ACACGA, ACACGC, ACACGU, ACACUC, ACACUG, ACACUU, |
| ACAGAA, ACAGAC, ACAGCC, ACAGCG, ACAGCU, ACAGGG, ACAGUC, ACAGUG, ACAGUU, ACAUAA, |
| ACAUAC, ACAUCC, ACAUCG, ACAUCU, ACAUGA, ACAUGC, ACAUGU, ACAUUG, ACAUUU, ACCAAA, |
| ACCAAC, ACCAAG, ACCAAU, ACCACC, ACCACG, ACCAGA, ACCAGU, ACCAUA, ACCAUG, ACCAUU, |
| ACCCAA, ACCCAC, ACCCCA, ACCCCG, ACCCGA, ACCCGC, ACCCUA, ACCCUC, ACCCUU, ACCGAA, |
| ACCGAC, ACCGAU, ACCGCA, ACCGCC, ACCGCG, ACCGCU, ACCGGA, ACCGGC, ACCGGU, ACCGUA, |
| ACCGUC, ACCGUG, ACCGUU, ACCUAA, ACCUAC, ACCUAG, ACCUAU, ACCUCA, ACCUCC, ACCUCG, |
| ACCUCU, ACCUGA, ACCUGC, ACCUGU, ACCUUA, ACCUUC, ACCUUU, ACGAAA, ACGAAC, ACGAAG, |
| ACGAAU, ACGACA, ACGACC, ACGACG, ACGACU, ACGAGA, ACGAGC, ACGAGG, ACGAGU, ACGAUA, |
| ACGAUC, ACGAUG, ACGAUU, ACGCAA, ACGCAG, ACGCAU, ACGCCC, ACGCCG, ACGCCU, ACGCGA, |
| ACGCGG, ACGCGU, ACGCUA, ACGCUG, ACGCUU, ACGGAA, ACGGAC, ACGGAG, ACGGAU, ACGGCC, |
| ACGGCG, ACGGCU, ACGGGC, ACGGGG, ACGGGU, ACGGUA, ACGGUC, ACGGUG, ACGGUU, ACGUAA, |
| ACGUAC, ACGUAU, ACGUCC, ACGUCG, ACGUCU, ACGUGA, ACGUGC, ACGUGG, ACGUGU, ACGUUA, |
| ACGUUC, ACGUUG, ACGUUU, ACUAAA, ACUAAG, ACUAAU, ACUACA, ACUACC, ACUACG, ACUACU, |

TABLE 1-continued

Hexamers that are not seed sequences of human miRNAs

ACUAGG, ACUAUC, ACUAUG, ACUAUU, ACUCAU, ACUCCC, ACUCCG, ACUCCU, ACUCGA, ACUCGC,
ACUCGG, ACUCUC, ACUCUU, ACUGAG, ACUGAU, ACUGCC, ACUGCG, ACUGCU, ACUGGG, ACUGGU,
ACUGUC, ACUUAA, ACUUAC, ACUUAU, ACUUCA, ACUUCC, ACUUCG, ACUUCU, ACUUGA, ACUUGC,
ACUUGU, ACUUUA, ACUUUC, ACUUUG, AGAAAA, AGAAAC, AGAAAG, AGAACC, AGAACG, AGAACU,
AGAAGC, AGAAGU, AGAAUA, AGAAUC, AGAAUG, AGAAUU, AGACAA, AGACAC, AGACAU, AGACCA,
AGACCC, AGACCG, AGACCU, AGACGA, AGACGC, AGACGU, AGACUA, AGACUC, AGACUU, AGAGAC,
AGAGAG, AGAGAU, AGAGCC, AGAGCG, AGAGCU, AGAGGC, AGAGGG, AGAGGU, AGAGUA, AGAGUU,
AGAUAC, AGAUAG, AGAUAU, AGAUCC, AGAUCG, AGAUCU, AGAUGA, AGAUGC, AGAUGG, AGAUUA,
AGAUUC, AGAUUG, AGAUUU, AGCAAC, AGCACA, AGCACG, AGCACU, AGCAGA, AGCAUA, AGCAUC,
AGCAUG, AGCCAA, AGCCAU, AGCCCA, AGCCGA, AGCCGC, AGCCGG, AGCCGU, AGCCUA, AGCCUC,
AGCGAA, AGCGAG, AGCGAU, AGCGCA, AGCGCC, AGCGCG, AGCGCU, AGCGGA, AGCGGC, AGCGGU,
AGCGUA, AGCGUC, AGCGUG, AGCGUU, AGCUAA, AGCUAC, AGCUAG, AGCUAU, AGCUCA, AGCUCC,
AGCUCG, AGCUCU, AGCUGA, AGCUGG, AGCUGU, AGCUUC, AGCUUU, AGGAAU, AGGACC, AGGACG,
AGGAGA, AGGAGU, AGGAUA, AGGCAA, AGGCAU, AGGCCG, AGGCGA, AGGCGC, AGGCGG, AGGCUA,
AGGCUC, AGGCUU, AGGGAC, AGGGAU, AGGGGA, AGGGGU, AGGGUA, AGGGUG, AGGUAA, AGGUAC,
AGGUCA, AGGUCC, AGGUCU, AGGUGA, AGGUGC, AGGUGG, AGGUGU, AGGUUC, AGGUUG, AGUAAA,
AGUAAG, AGUAAU, AGUACA, AGUACG, AGUAGC, AGUAGG, AGUAUA, AGUAUC, AGUAUG, AGUAUU,
AGUCAA, AGUCAC, AGUCAG, AGUCAU, AGUCCA, AGUCCG, AGUCCU, AGUCGA, AGUCGC, AGUCGG,
AGUCGU, AGUCUA, AGUCUC, AGUCUG, AGUCUU, AGUGAA, AGUGAC, AGUGCG, AGUGGG, AGUGUC,
AGUUAA, AGUUAC, AGUUAG, AGUUCC, AGUUCG, AGUUGA, AGUUGC, AGUUGU, AGUUUA, AGUUUC,
AGUUUG, AGUUUU, AUAAAC, AUAAAU, AUAACA, AUAACC, AUAACG, AUAACU, AUAAGA, AUAAGC,
AUAAGG, AUAAGU, AUAAUC, AUAAUG, AUAAUU, AUACAC, AUACAG, AUACAU, AUACCA, AUACCC,
AUACCG, AUACGA, AUACGC, AUACGG, AUACGU, AUACUA, AUACUC, AUACUG, AUACUU, AUAGAA,
AUAGAC, AUAGAU, AUAGCA, AUAGCG, AUAGCU, AUAGGA, AUAGGU, AUAGUA, AUAGUC, AUAGUG,
AUAGUU, AUAUAC, AUAUAG, AUAUCC, AUAUCG, AUAUCU, AUAUGA, AUAUGC, AUAUGG, AUAUGU,
AUAUUC, AUAUUG, AUAUUU, AUCAAA, AUCAAC, AUCAAG, AUCAAU, AUCACA, AUCACC, AUCACG,
AUCAGC, AUCAGG, AUCCAA, AUCCAU, AUCCCC, AUCCCG, AUCCGA, AUCCGC, AUCCGG, AUCCUA,
AUCCUC, AUCCUG, AUCGAA, AUCGAC, AUCGAG, AUCGAU, AUCGCA, AUCGCC, AUCGCG, AUCGCU,
AUCGGC, AUCGGG, AUCGGU, AUCGUC, AUCGUG, AUCGUU, AUCUAA, AUCUAC, AUCUAG, AUCUAU,
AUCUCC, AUCUCG, AUCUGU, AUCUUG, AUCUUU, AUGAAA, AUGAAC, AUGAAG, AUGAAU, AUGACC,
AUGACU, AUGAGG, AUGAGU, AUGAUA, AUGAUC, AUGAUU, AUGCAA, AUGCAG, AUGCCA, AUGCCC,
AUGCCG, AUGCGA, AUGCGG, AUGCGU, AUGCUC, AUGCUU, AUGGAC, AUGGCC, AUGGGA, AUGGGC,
AUGGGU, AUGGUC, AUGGUG, AUGUAC, AUGUAU, AUGUCA, AUGUCC, AUGUCG, AUGUGU, AUGUUA,
AUGUUC, AUUAAA, AUUAAC, AUUAAG, AUUAAU, AUUACA, AUUACC, AUUACG, AUUACU, AUUAGA,
AUUAGC, AUUAGG, AUUAGU, AUUAUA, AUUAUC, AUUAUG, AUUCAC, AUUCCA, AUUCCG, AUUCCU,
AUUCGA, AUUCGC, AUUCGG, AUUCGU, AUUCUA, AUUCUC, AUUCUU, AUUGAA, AUUGAC, AUUGAU,
AUUGCC, AUUGCG, AUUGCU, AUUGGA, AUUGGC, AUUGGG, AUUGGU, AUUGUA, AUUGUC, AUUGUG,
AUUGUU, AUUUAA, AUUUAG, AUUUAU, AUUUCC, AUUUCG, AUUUCU, AUUUGA, AUUUGC, AUUUGU,
AUUUUA, AUUUUC, AUUUUG, AUUUUU, CAAAAG, CAAACA, CAAACC, CAAACG, CAAACU, CAAAGA,

TABLE 1-continued

Hexamers that are not seed sequences of human miRNAs

CAAAGG, CAAAUA, CAAAUU, CAACAC, CAACAU, CAACCA, CAACCC, CAACCG, CAACGA, CAACGC,
CAACGG, CAACGU, CAACUA, CAACUC, CAACUG, CAACUU, CAAGAA, CAAGAC, CAAGAU, CAAGCA,
CAAGCC, CAAGCG, CAAGCU, CAAGGA, CAAGGG, CAAGUC, CAAGUG, CAAGUU, CAAUAA, CAAUAC,
CAAUAG, CAAUCC, CAAUCG, CAAUCU, CAAUGA, CAAUGC, CAAUGG, CAAUGU, CAAUUC, CAAUUG,
CAAUUU, CACAAU, CACACA, CACACG, CACACU, CACAGA, CACAGC, CACAGG, CACAUA, CACAUC,
CACAUU, CACCAA, CACCAC, CACCAU, CACCCA, CACCCC, CACCCG, CACCGA, CACCGC, CACCGG,
CACCGU, CACCUA, CACCUU, CACGAA, CACGAC, CACGAG, CACGAU, CACGCA, CACGCC, CACGCU,
CACGGA, CACGGC, CACGGG, CACGGU, CACGUA, CACGUC, CACGUG, CACGUU, CACUAA, CACUAG,
CACUAU, CACUCA, CACUCG, CACUGA, CACUGC, CACUGG, CACUUA, CACUUC, CACUUU, CAGAAA,
CAGAAG, CAGAAU, CAGACC, CAGACG, CAGAGC, CAGAUA, CAGAUC, CAGCCG, CAGCCU, CAGCGA,
CAGCGC, CAGCGG, CAGCGU, CAGCUC, CAGCUU, CAGGAU, CAGGGG, CAGGGU, CAGGUA, CAGGUC,
CAGGUU, CAGUAC, CAGUCG, CAGUUG, CAUAAA, CAUAAC, CAUAAG, CAUAAU, CAUACA, CAUACC,
CAUACG, CAUACU, CAUAGA, CAUAGG, CAUAGU, CAUAUA, CAUAUC, CAUAUG, CAUCAA, CAUCAC,
CAUCAG, CAUCAU, CAUCCA, CAUCCC, CAUCCG, CAUCGA, CAUCGC, CAUCGG, CAUCGU, CAUCUA,
CAUCUC, CAUCUG, CAUCUU, CAUGAA, CAUGAC, CAUGAG, CAUGAU, CAUGCA, CAUGCC, CAUGCG,
CAUGCU, CAUGGC, CAUGGG, CAUGGU, CAUGUA, CAUGUC, CAUGUU, CAUUAA, CAUUAC, CAUUAG,
CAUUCA, CAUUCC, CAUUCG, CAUUCU, CAUUGA, CAUUGG, CAUUUC, CAUUUG, CAUUUU, CCAAAA,
CCAAAC, CCAAAG, CCAAAU, CCAACA, CCAACC, CCAACG, CCAACU, CCAAGA, CCAAGC, CCAAGG,
CCAAUC, CCAAUG, CCAAUU, CCACAA, CCACAC, CCACAG, CCACAU, CCACCA, CCACCC, CCACCG,
CCACCU, CCACGA, CCACGC, CCACGG, CCACGU, CCACUA, CCACUC, CCACUU, CCAGAA, CCAGAC,
CCAGAG, CCAGCC, CCAGGU, CCAGUC, CCAGUU, CCAUAA, CCAUAC, CCAUAG, CCAUAU, CCAUCA,
CCAUCC, CCAUCU, CCAUGA, CCAUGC, CCAUGG, CCAUUC, CCAUUG, CCAUUU, CCCAAC, CCCAAG,
CCCAAU, CCCACA, CCCAGA, CCCAGC, CCCAGU, CCCAUA, CCCAUC, CCCAUG, CCCAUU, CCCCAA,
CCCCAG, CCCCAU, CCCCCC, CCCCCG, CCCCCU, CCCCGA, CCCCGC, CCCCGU, CCCCUA, CCCCUC,
CCCGAA, CCCGAC, CCCGAU, CCCGCA, CCCGCU, CCCGGA, CCCGGC, CCCGUA, CCCGUG, CCCGUU,
CCCUAA, CCCUAG, CCCUCA, CCCUCU, CCCUGC, CCCUUA, CCCUUC, CCCUUU, CCGAAA, CCGAAC,
CCGAAU, CCGACA, CCGACC, CCGACG, CCGACU, CCGAGA, CCGAGG, CCGAGU, CCGAUA, CCGAUC,
CCGAUG, CCGAUU, CCGCAA, CCGCAC, CCGCAG, CCGCAU, CCGCCA, CCGCCC, CCGCCG, CCGCCU,
CCGCGA, CCGCGC, CCGCGG, CCGCGU, CCGCUA, CCGCUC, CCGCUG, CCGCUU, CCGGAA, CCGGAU,
CCGGCA, CCGGCC, CCGGCG, CCGGCU, CCGGGA, CCGGGC, CCGGGG, CCGGGU, CCGGUA, CCGGUC,
CCGGUG, CCGUAA, CCGUAG, CCGUAU, CCGUCA, CCGUCC, CCGUCG, CCGUGA, CCGUGU, CCGUUA,
CCGUUC, CCGUUG, CCGUUU, CCUAAC, CCUAAG, CCUAAU, CCUACA, CCUACC, CCUACG, CCUACU,
CCUAGA, CCUAGC, CCUAGG, CCUAGU, CCUAUA, CCUAUC, CCUAUG, CCUAUU, CCUCAA, CCUCAC,
CCUCAG, CCUCAU, CCUCCA, CCUCCC, CCUCCG, CCUCGA, CCUCGC, CCUCGG, CCUCGU, CCUCUA,
CCUCUG, CCUGAC, CCUGAU, CCUGCA, CCUGGG, CCUGGU, CCUGUU, CCUUAA, CCUUAC, CCUUAG,
CCUUAU, CCUUCG, CCUUGA, CCUUGU, CCUUUA, CCUUUC, CCUUUU, CGAAAA, CGAAAC, CGAAAG,
CGAAAU, CGAACA, CGAACC, CGAACG, CGAACU, CGAAGA, CGAAGC, CGAAGG, CGAAGU, CGAAUA,
CGAAUC, CGAAUG, CGAAUU, CGACAA, CGACAC, CGACAU, CGACCA, CGACCU, CGACGA, CGACGC,
CGACGG, CGACGU, CGACUA, CGACUG, CGACUU, CGAGAA, CGAGAC, CGAGAG, CGAGAU, CGAGCA,

TABLE 1-continued

Hexamers that are not seed sequences of human miRNAs

CGAGCC, CGAGCG, CGAGCU, CGAGGC, CGAGGG, CGAGGU, CGAGUA, CGAGUC, CGAGUG, CGAGUU,
CGAUAA, CGAUAC, CGAUAG, CGAUAU, CGAUCA, CGAUCC, CGAUCG, CGAUCU, CGAUGA, CGAUGC,
CGAUGG, CGAUGU, CGAUUA, CGAUUC, CGAUUG, CGAUUU, CGCAAA, CGCAAC, CGCAAG, CGCAAU,
CGCACA, CGCACC, CGCACG, CGCAGA, CGCAGC, CGCAGG, CGCAGU, CGCAUA, CGCAUC, CGCAUG,
CGCAUU, CGCCAA, CGCCAC, CGCCAG, CGCCAU, CGCCCA, CGCCCC, CGCCCG, CGCCGA, CGCCGC,
CGCCGG, CGCCGU, CGCCUA, CGCCUG, CGCCUU, CGCGAA, CGCGAC, CGCGAG, CGCGAU, CGCGCA,
CGCGCC, CGCGCG, CGCGCU, CGCGGA, CGCGGC, CGCGGG, CGCGGU, CGCGUA, CGCGUC, CGCGUG,
CGCGUU, CGCUAA, CGCUAC, CGCUAG, CGCUAU, CGCUCA, CGCUCC, CGCUCG, CGCUCU, CGCUGA,
CGCUGC, CGCUGG, CGCUGU, CGCUUA, CGCUUC, CGCUUG, CGGAAA, CGGAAC, CGGAAG, CGGACA,
CGGACC, CGGACG, CGGACU, CGGAGC, CGGAGG, CGGAGU, CGGAUA, CGGAUU, CGGCAA, CGGCAC,
CGGCAG, CGGCCA, CGGCCC, CGGCCG, CGGCGC, CGGCGG, CGGCGU, CGGCUA, CGGCUC, CGGCUG,
CGGCUU, CGGGAA, CGGGAC, CGGGAG, CGGGAU, CGGGCA, CGGGCC, CGGGCG, CGGGCU, CGGGGU,
CGGGUA, CGGGUC, CGGGUG, CGGUAA, CGGUAC, CGGUAG, CGGUAU, CGGUCA, CGGUCG, CGGUCU,
CGGUGA, CGGUGG, CGGUGU, CGGUUA, CGGUUC, CGGUUG, CGGUUU, CGUAAA, CGUAAC, CGUAAG,
CGUAAU, CGUACA, CGUACG, CGUACU, CGUAGA, CGUAGC, CGUAGG, CGUAGU, CGUAUA, CGUAUC,
CGUAUG, CGUAUU, CGUCAA, CGUCAC, CGUCAG, CGUCAU, CGUCCA, CGUCCC, CGUCCG, CGUCCU,
CGUCGA, CGUCGG, CGUCGU, CGUCUA, CGUCUC, CGUCUG, CGUCUU, CGUGAA, CGUGAC, CGUGAG,
CGUGAU, CGUGCC, CGUGCG, CGUGCU, CGUGGA, CGUGGG, CGUGGU, CGUGUA, CGUGUG, CGUUAA,
CGUUAC, CGUUAG, CGUUAU, CGUUCA, CGUUCC, CGUUCG, CGUUCU, CGUUGA, CGUUGC, CGUUGU,
CGUUUA, CGUUUC, CGUUUU, CUAAAA, CUAAAC, CUAAAU, CUAACA, CUAACC, CUAACG, CUAACU,
CUAAGA, CUAAGC, CUAAGU, CUAAUA, CUAAUC, CUAAUG, CUACAC, CUACAU, CUACCA, CUACCC,
CUACCG, CUACCU, CUACGA, CUACGC, CUACGG, CUACGU, CUACUA, CUACUC, CUACUG, CUAGAA,
CUAGAG, CUAGAU, CUAGCA, CUAGCC, CUAGCG, CUAGCU, CUAGGA, CUAGGG, CUAGGU, CUAGUG,
CUAGUU, CUAUAA, CUAUAG, CUAUAU, CUAUCA, CUAUCC, CUAUCG, CUAUCU, CUAUGA, CUAUGC,
CUAUGG, CUAUGU, CUAUUA, CUAUUG, CUCAAC, CUCAAG, CUCAAU, CUCACC, CUCACG, CUCAGC,
CUCAUA, CUCAUC, CUCAUG, CUCAUU, CUCCAC, CUCCCC, CUCCCG, CUCCGA, CUCCGC, CUCCGG,
CUCCUA, CUCCUC, CUCCUU, CUCGAA, CUCGAC, CUCGAG, CUCGAU, CUCGCA, CUCGCC, CUCGCG,
CUCGGG, CUCGGU, CUCGUA, CUCGUC, CUCGUG, CUCGUU, CUCUAA, CUCUAC, CUCUAU, CUCUCA,
CUCUCC, CUCUCU, CUCUGC, CUCUGU, CUCUUA, CUCUUG, CUGAAG, CUGACC, CUGACG, CUGAGC,
CUGAUA, CUGAUC, CUGCCG, CUGCCU, CUGCGA, CUGCUA, CUGCUU, CUGGAG, CUGGAU, CUGGCG,
CUGGGU, CUGUAC, CUGUCA, CUGUCC, CUGUCG, CUGUGG, CUGUGU, CUGUUA, CUGUUU, CUUAAC,
CUUAAG, CUUAAU, CUUACC, CUUACG, CUUAGA, CUUAGC, CUUAGG, CUUAGU, CUUAUA, CUUAUC,
CUUAUG, CUUAUU, CUUCAG, CUUCAU, CUUCCA, CUUCCC, CUUCCG, CUUCCU, CUUCGA, CUUCGC,
CUUCGG, CUUCGU, CUUCUA, CUUGAC, CUUGAG, CUUGAU, CUUGCA, CUUGCC, CUUGCG, CUUGCU,
CUUGGC, CUUGGU, CUUGUU, CUUUAC, CUUUAG, CUUUAU, CUUUCA, CUUUCG, CUUUCU, CUUUGA,
CUUUGC, CUUUGU, CUUUUA, CUUUUC, CUUUUG, CUUUUU, GAAAAA, GAAAAG, GAAAAU, GAAACC,
GAAACG, GAAAGA, GAAAGC, GAAAGU, GAAAUA, GAAAUC, GAAAUG, GAAAUU, GAACAA, GAACAC,
GAACAG, GAACAU, GAACCA, GAACCC, GAACCG, GAACCU, GAACGA, GAACGC, GAACGG, GAACGU,
GAACUA, GAACUG, GAACUU, GAAGAC, GAAGAG, GAAGCA, GAAGCG, GAAGCU, GAAGUC, GAAUAA,

TABLE 1-continued

Hexamers that are not seed sequences of human miRNAs

GAAUAC, GAAUAG, GAAUAU, GAAUCC, GAAUCG, GAAUCU, GAAUGA, GAAUGC, GAAUGU, GAAUUA,
GAAUUC, GAAUUU, GACAAA, GACAAG, GACAAU, GACACC, GACAGA, GACAGG, GACAUA, GACAUG,
GACAUU, GACCAA, GACCAC, GACCAG, GACCCA, GACCCC, GACCCG, GACCGC, GACCGG, GACCGU,
GACCUA, GACCUC, GACCUU, GACGAA, GACGAC, GACGAG, GACGAU, GACGCA, GACGCC, GACGCG,
GACGCU, GACGGA, GACGGC, GACGGG, GACGGU, GACGUA, GACGUC, GACGUG, GACGUU, GACUAA,
GACUAC, GACUAG, GACUAU, GACUCA, GACUCC, GACUCG, GACUGG, GACUGU, GACUUA, GACUUG,
GACUUU, GAGAAU, GAGAGA, GAGAGC, GAGAGG, GAGAUA, GAGAUC, GAGCAA, GAGCAU, GAGCCA,
GAGCGA, GAGCGG, GAGCGU, GAGGGU, GAGGUC, GAGGUG, GAGUAA, GAGUAG, GAGUCC, GAGUUC,
GAGUUU, GAUAAA, GAUAAC, GAUAAG, GAUAAU, GAUACA, GAUACC, GAUACG, GAUACU, GAUAGA,
GAUAGC, GAUAGG, GAUAGU, GAUAUA, GAUCAA, GAUCAC, GAUCAU, GAUCCA, GAUCCC, GAUCCU,
GAUCGC, GAUCGG, GAUCGU, GAUCUA, GAUCUG, GAUCUU, GAUGAA, GAUGAC, GAUGAG, GAUGCA,
GAUGCC, GAUGCG, GAUGCU, GAUGGC, GAUGGG, GAUGGU, GAUGUG, GAUGUU, GAUUAA, GAUUAC,
GAUUAG, GAUUAU, GAUUCA, GAUUCG, GAUUCU, GAUUGA, GAUUGC, GAUUUA, GAUUUC, GAUUUG,
GAUUUU, GCAAAC, GCAAAG, GCAAAU, GCAACA, GCAACC, GCAAGC, GCAAGU, GCAAUA, GCAAUC,
GCAAUG, GCAAUU, GCACAA, GCACAC, GCACAG, GCACCC, GCACCG, GCACCU, GCACGA, GCACGC,
GCACGU, GCACUA, GCACUC, GCACUG, GCACUU, GCAGAU, GCAGCC, GCAGCG, GCAGGC, GCAGUA,
GCAGUC, GCAGUG, GCAGUU, GCAUAA, GCAUAG, GCAUAU, GCAUCG, GCAUCU, GCAUGA, GCAUGC,
GCAUGG, GCAUGU, GCAUUA, GCAUUC, GCAUUG, GCAUUU, GCCAAA, GCCAAC, GCCAAU, GCCACA,
GCCACC, GCCACG, GCCAGA, GCCAGU, GCCAUA, GCCAUC, GCCAUG, GCCAUU, GCCCAA, GCCCAC,
GCCCAG, GCCCCG, GCCCGA, GCCCGG, GCCCGU, GCCGAA, GCCGAC, GCCGAG, GCCGAU, GCCGCA,
GCCGCU, GCCGGA, GCCGGC, GCCGGG, GCCGGU, GCCGUA, GCCGUC, GCCGUG, GCCGUU, GCCUAA,
GCCUAU, GCCUCA, GCCUCC, GCCUCG, GCCUGA, GCCUUA, GCCUUU, GCGAAA, GCGAAC, GCGAAG,
GCGAAU, GCGACC, GCGACG, GCGACU, GCGAGA, GCGAGC, GCGAGG, GCGAGU, GCGAUA, GCGAUC,
GCGAUG, GCGAUU, GCGCAA, GCGCAC, GCGCAG, GCGCAU, GCGCCA, GCGCCC, GCGCCU, GCGCGA,
GCGCGU, GCGCUA, GCGCUC, GCGCUG, GCGCUU, GCGGAA, GCGGAC, GCGGAU, GCGGCA, GCGGCC,
GCGGCU, GCGGGA, GCGGUA, GCGGUC, GCGGUU, GCGUAA, GCGUAC, GCGUAG, GCGUAU, GCGUCA,
GCGUCC, GCGUCG, GCGUCU, GCGUGA, GCGUGC, GCGUGG, GCGUGU, GCGUUA, GCGUUC, GCGUUG,
GCGUUU, GCUAAA, GCUAAC, GCUAAG, GCUAAU, GCUACC, GCUACG, GCUACU, GCUAGA, GCUAGG,
GCUAGU, GCUAUA, GCUAUC, GCUAUU, GCUCAA, GCUCAC, GCUCAG, GCUCAU, GCUCCA, GCUCCC,
GCUCCG, GCUCGA, GCUCGC, GCUCGU, GCUCUA, GCUCUC, GCUCUU, GCUGAA, GCUGAC, GCUGAU,
GCUGCA, GCUGCC, GCUGCG, GCUGCU, GCUGUG, GCUGUU, GCUUAC, GCUUAG, GCUUAU, GCUUCA,
GCUUCG, GCUUGA, GCUUGG, GCUUGU, GCUUUA, GCUUUG, GGAAAG, GGAACA, GGAACC, GGAACG,
GGAACU, GGAAGU, GGAAUA, GGAAUC, GGAAUU, GGACAA, GGACAC, GGACAG, GGACAU, GGACCG,
GGACGA, GGACGC, GGACGU, GGACUA, GGACUC, GGACUU, GGAGAC, GGAGCA, GGAGCG, GGAGGG,
GGAGUA, GGAUAA, GGAUAC, GGAUCA, GGAUCC, GGAUCG, GGAUCU, GGAUGC, GGAUUA, GGAUUG,
GGCAAU, GGCACA, GGCACU, GGCAGA, GGCAUA, GGCAUC, GGCCAC, GGCCAG, GGCCCC, GGCCGA,
GGCCGC, GGCCGU, GGCCUA, GGCCUG, GGCCUU, GGCGAA, GGCGAG, GGCGAU, GGCGCA, GGCGCU,
GGCGGU, GGCGUA, GGCGUC, GGCGUG, GGCGUU, GGCUAA, GGCUAC, GGCUAG, GGCUAU, GGCUCC,
GGCUCG, GGCUGA, GGCUUA, GGCUUC, GGCUUG, GGGAAU, GGGACA, GGGAGA, GGGAGU, GGGAUA,

TABLE 1-continued

Hexamers that are not seed sequences of human miRNAs

GGGAUU, GGGCAA, GGGCAC, GGGCAG, GGGCCG, GGGCGG, GGGGCC, GGGGGG, GGGGGU, GGGGUA,
GGGUAC, GGGUAU, GGGUCA, GGGUCC, GGGUCG, GGGUGA, GGGUGC, GGGUUA, GGGUUG, GGUAAA,
GGUAAC, GGUAAG, GGUAAU, GGUACA, GGUACC, GGUACG, GGUACU, GGUAGC, GGUAGG, GGUAGU,
GGUAUA, GGUAUC, GGUAUG, GGUCAA, GGUCAC, GGUCAG, GGUCAU, GGUCCA, GGUCCG, GGUCCU,
GGUCGA, GGUCGC, GGUCGG, GGUCGU, GGUCUC, GGUCUU, GGUGAA, GGUGAC, GGUGAU, GGUGCA,
GGUGCC, GGUGGC, GGUGUA, GGUGUC, GGUUAA, GGUUAG, GGUUAU, GGUUCA, GGUUCC, GGUUCG,
GGUUGC, GGUUUC, GGUUUU, GUAAAA, GUAAAG, GUAAAU, GUAACC, GUAACG, GUAACU, GUAAGA,
GUAAGC, GUAAGG, GUAAGU, GUAAUA, GUAAUC, GUAAUG, GUAAUU, GUACAA, GUACAC, GUACAG,
GUACAU, GUACCA, GUACCC, GUACCG, GUACCU, GUACGA, GUACGC, GUACGG, GUACGU, GUACUA,
GUACUC, GUACUG, GUACUU, GUAGAA, GUAGAC, GUAGCA, GUAGCC, GUAGCG, GUAGCU, GUAGGA,
GUAGGC, GUAGGG, GUAGGU, GUAGUA, GUAGUC, GUAUAA, GUAUAC, GUAUAG, GUAUAU, GUAUCA,
GUAUCG, GUAUCU, GUAUGA, GUAUGC, GUAUGG, GUAUUA, GUAUUG, GUAUUU, GUCAAA, GUCAAG,
GUCAAU, GUCACA, GUCACC, GUCACG, GUCAGA, GUCAGC, GUCAGG, GUCAUA, GUCAUC, GUCAUG,
GUCCAA, GUCCAC, GUCCAU, GUCCCC, GUCCCU, GUCCGA, GUCCGC, GUCCGG, GUCCGU, GUCCUA,
GUCCUG, GUCCUU, GUCGAA, GUCGAC, GUCGAG, GUCGAU, GUCGCA, GUCGCC, GUCGCG, GUCGCU,
GUCGGA, GUCGGC, GUCGGG, GUCGGU, GUCGUA, GUCGUC, GUCGUU, GUCUAA, GUCUAG, GUCUCA,
GUCUCC, GUCUCG, GUCUGA, GUCUGG, GUCUGU, GUCUUC, GUCUUU, GUGAAA, GUGAAC, GUGAAG,
GUGACC, GUGACG, GUGAGA, GUGAGC, GUGAGU, GUGAUC, GUGAUG, GUGAUU, GUGCAC, GUGCAU,
GUGCCC, GUGCCG, GUGCGA, GUGCGG, GUGCGU, GUGCUA, GUGCUC, GUGCUG, GUGGAG, GUGGCG,
GUGGCU, GUGGGU, GUGGUC, GUGGUG, GUGUAA, GUGUAG, GUGUCG, GUGUGA, GUGUGC, GUGUGU,
GUGUUG, GUGUUU, GUUAAA, GUUAAC, GUUAAG, GUUACA, GUUACC, GUUACG, GUUACU, GUUAGA,
GUUAGC, GUUAGU, GUUAUA, GUUAUC, GUUAUG, GUUAUU, GUUCAA, GUUCAC, GUUCAG, GUUCCA,
GUUCCG, GUUCGA, GUUCGC, GUUCGG, GUUCGU, GUUCUA, GUUCUG, GUUGAA, GUUGAC, GUUGAG,
GUUGAU, GUUGCG, GUUGCU, GUUGGA, GUUGGC, GUUGGU, GUUGUC, GUUGUG, GUUGUU, GUUUAA,
GUUUAC, GUUUAG, GUUUAU, GUUUCA, GUUUCC, GUUUCU, GUUUGA, GUUUGC, GUUUGG, GUUUGU,
GUUUUA, GUUUUC, GUUUUU, UAAAAA, UAAAAC, UAAAAG, UAAAAU, UAAACA, UAAACC, UAAACG,
UAAACU, UAAGA, UAAAGG, UAAAGU, UAAAUA, UAAAUC, UAAAUG, UAAAUU, UACAA, UAACAC,
UAACAG, UAACCA, UAACCC, UAACCG, UAACCU, UAACGA, UAACGC, UAACGG, UAACGU, UAACUA,
UAACUG, UAACUU, UAAGAG, UAAGAU, UAAGCA, UAAGCC, UAAGCG, UAAGCU, UAAGGA, UAAGGC,
UAAGGG, UAAGGU, UAAGUA, UAAGUC, UAAGUG, UAAGUU, UAAUAA, UAAUCA, UAAUCC, UAAUCG,
UAAUCU, UAAUGA, UAAUGG, UAAUGU, UAAUUA, UAAUUC, UAAUUG, UACAAC, UACAAG, UACAAU,
UACACC, UACACG, UACACU, UACAGA, UACAGC, UACAUA, UACAUC, UACAUU, UACCAA, UACCAC,
UACCAG, UACCAU, UACCCC, UACCCG, UACCCU, UACCGA, UACCGC, UACCGG, UACCGU, UACCUA,
UACCUG, UACGAA, UACGAC, UACGAG, UACGAU, UACGCA, UACGCC, UACGCG, UACGCU, UACGGC,
UACGGG, UACGGU, UACGUA, UACGUC, UACGUG, UACGUU, UACUAA, UACUAC, UACUAG, UACUAU,
UACUCA, UACUCC, UACUCG, UACUCU, UACUGA, UACUGC, UACUGG, UACUUA, UACUUG, UACUUU,
UAGAAA, UAGAAG, UAGAAU, UAGACA, UAGACG, UAGAGA, UAGAGC, UAGAGU, UAGAUA, UAGAUC,
UAGAUG, UAGCAU, UAGCCC, UAGCCG, UAGCCU, UAGCGA, UAGCGC, UAGCGU, UAGCUA, UAGCUC,
UAGCUG, UAGGAA, UAGGAU, UAGGCG, UAGGCU, UAGGGU, UAGGUC, UAGGUG, UAGGUU, UAGUAA,

TABLE 1-continued

Hexamers that are not seed sequences of human miRNAs

UAGUAC, UAGUAG, UAGUAU, UAGUCA, UAGUCG, UAGUGU, UAGUUA, UAGUUC, UAGUUG, UAGUUU,
UAUAAC, UAUAAG, UAUACU, UAUAGA, UAUAGC, UAUAGG, UAUAGU, UAUAUA, UAUAUC, UAUAUG,
UAUAUU, UAUCAA, UAUCAC, UAUCAU, UAUCCA, UAUCCC, UAUCCG, UAUCCU, UAUCGA, UAUCGC,
UAUCGG, UAUCGU, UAUCUA, UAUCUC, UAUCUG, UAUCUU, UAUGAA, UAUGAC, UAUGAG, UAUGAU,
UAUGCA, UAUGCG, UAUGCU, UAUGGA, UAUGGC, UAUGUC, UAUGUG, UAUGUU, UAUUAG, UAUUCA,
UAUUCC, UAUUCG, UAUUCU, UAUUGA, UAUUGG, UAUUUA, UAUUUC, UAUUUG, UAUUUU, UCAAAA,
UCAAAC, UCAAAG, UCAACC, UCAACU, UCAAGA, UCAAGC, UCAAUA, UCAAUC, UCAAUG, UCAAUU,
UCACCC, UCACCG, UCACCU, UCACGA, UCACGC, UCACGG, UCACGU, UCACUA, UCACUC, UCACUU,
UCAGAA, UCAGAC, UCAGAG, UCAGCG, UCAGCU, UCAGGA, UCAGGC, UCAGGU, UCAGUC, UCAGUU,
UCAUAA, UCAUCA, UCAUCC, UCAUCG, UCAUGC, UCAUGG, UCAUGU, UCAUUA, UCAUUG, UCCAAA,
UCCAAC, UCCAAG, UCCAAU, UCCACA, UCCACC, UCCACG, UCCAGC, UCCAGG, UCCAUA, UCCAUC,
UCCAUU, UCCCAA, UCCCAG, UCCCAU, UCCCCC, UCCCCG, UCCCCU, UCCCGA, UCCCGC, UCCCGG,
UCCCGU, UCCCUA, UCCCUC, UCCGAA, UCCGAC, UCCGAG, UCCGAU, UCCGCA, UCCGCC, UCCGGA,
UCCGGC, UCCGGU, UCCGUA, UCCGUC, UCCGUG, UCCUAA, UCCUCA, UCCUCG, UCCUCU, UCCUGC,
UCCUGU, UCCUUA, UCCUUC, UCCUUU, UCGAAA, UCGAAC, UCGAAG, UCGAAU, UCGACA, UCGACC,
UCGACG, UCGACU, UCGAGA, UCGAGC, UCGAGG, UCGAUA, UCGAUC, UCGAUG, UCGAUU, UCGCAA,
UCGCAC, UCGCAG, UCGCAU, UCGCCA, UCGCCC, UCGCCG, UCGCCU, UCGCGA, UCGCGC, UCGCGU,
UCGCUA, UCGCUC, UCGGAA, UCGGAC, UCGGAG, UCGGAU, UCGGCA, UCGGCU, UCGGGG, UCGGGU,
UCGGUC, UCGGUG, UCGGUU, UCGUAA, UCGUAC, UCGUAG, UCGUAU, UCGUCA, UCGUCC, UCGUCG,
UCGUCU, UCGUGA, UCGUGU, UCGUUA, UCGUUC, UCGUUG, UCGUUU, UCUAAC, UCUAAG, UCUAAU,
UCUACA, UCUACC, UCUACG, UCUACU, UCUAGC, UCUAGG, UCUAGU, UCUAUA, UCUAUC, UCUAUG,
UCUAUU, UCUCAG, UCUCAU, UCUCCG, UCUCGC, UCUCGG, UCUCGU, UCUCUC, UCUGAA, UCUGAU,
UCUGCA, UCUGCG, UCUGCU, UCUGGC, UCUGGU, UCUGUC, UCUGUG, UCUGUU, UCUUAA, UCUUAC,
UCUUAG, UCUUAU, UCUUCA, UCUUCC, UCUUCG, UCUUCU, UCUUGC, UCUUGG, UCUUGU, UCUUUA,
UCUUUC, UCUUUG, UCUUUU, UGAAAA, UGAAAC, UGAACA, UGAACC, UGAAGG, UGAAUC, UGAAUG,
UGACAA, UGACAC, UGACAG, UGACCA, UGACCC, UGACCG, UGACGA, UGACGC, UGACGG, UGACGU,
UGACUA, UGACUC, UGACUU, UGAGAG, UGAGAU, UGAGCA, UGAGCC, UGAGCU, UGAGGC, UGAGGU,
UGAGUA, UGAGUU, UGAUAC, UGAUAG, UGAUAU, UGAUCA, UGAUCG, UGAUCU, UGAUGA, UGAUGC,
UGAUGG, UGAUGU, UGAUUA, UGAUUC, UGAUUG, UGAUUU, UGCAAC, UGCAAG, UGCACA, UGCACG,
UGCAGG, UGCAGU, UGCAUC, UGCCCA, UGCCCC, UGCCCG, UGCCGA, UGCCGC, UGCCGG, UGCCGU,
UGCCUA, UGCCUC, UGCCUG, UGCCUU, UGCGAA, UGCGAC, UGCGAU, UGCGCC, UGCGCG, UGCGCU,
UGCGGC, UGCGGG, UGCGGU, UGCGUA, UGCGUC, UGCGUG, UGCGUU, UGCUAC, UGCUAU, UGCUCC,
UGCUCG, UGCUGC, UGCUGG, UGCUGU, UGCUUA, UGCUUU, UGGAAC, UGGAAG, UGGAGC, UGGAUC,
UGGAUU, UGGCAA, UGGCAC, UGGCAG, UGGCCG, UGGCCU, UGGCGA, UGGCGC, UGGCGU, UGGCUA,
UGGCUC, UGGCUU, UGGGAA, UGGGCA, UGGGCC, UGGGGC, UGGGUC, UGGUAA, UGGUAG, UGGUAU,
UGGUCC, UGGUCG, UGGUCU, UGGUGA, UGGUGC, UGGUGG, UGGUGU, UGGUUA, UGGUUG, UGUAAA,
UGUAAC, UGUAAG, UGUACC, UGUACG, UGUACU, UGUAGA, UGUAGC, UGUAGU, UGUAUC, UGUAUU,
UGUCAA, UGUCAC, UGUCAG, UGUCAU, UGUCCA, UGUCCC, UGUCCG, UGUCGA, UGUCGC, UGUCGG,
UGUCGU, UGUCUA, UGUCUC, UGUGAC, UGUGAG, UGUGAU, UGUGCA, UGUGGU, UGUGUA, UGUGUU,

TABLE 1-continued

Hexamers that are not seed sequences of human miRNAs

UGUUAC, UGUUAG, UGUUAU, UGUUCA, UGUUCC, UGUUCG, UGUUGG, UGUUGU, UGUUUA, UGUUUC, UGUUUG, UGUUUU, UUAAAA, UUAAAC, UUAAAG, UUAAAU, UUAACC, UUAACG, UUAACU, UUAAGU, UUAAUA, UUAAUC, UUAAUG, UUAAUU, UUACAA, UUACAC, UUACAG, UUACAU, UUACCA, UUACCC, UUACCG, UUACCU, UUACGA, UUACGC, UUACGG, UUACGU, UUACUA, UUACUC, UUACUG, UUACUU, UUAGAA, UUAGAC, UUAGCC, UUAGCG, UUAGCU, UUAGGC, UUAGGU, UUAGUA, UUAGUC, UUAGUU, UUAUAA, UUAUAC, UUAUAG, UUAUAU, UUAUCC, UUAUCG, UUAUCU, UUAUGA, UUAUGG, UUAUGU, UUAUUA, UUAUUC, UUAUUG, UUAUUU, UUCAAC, UUCAAU, UUCACA, UUCACC, UUCACG, UUCACU, UUCAGC, UUCAGG, UUCAGU, UUCAUA, UUCAUC, UUCAUG, UUCAUU, UUCCAA, UUCCCA, UUCCCG, UUCCGA, UUCCGU, UUCCUU, UUCGAA, UUCGAC, UUCGAG, UUCGAU, UUCGCA, UUCGCC, UUCGCG, UUCGCU, UUCGGA, UUCGGC, UUCGGG, UUCGGU, UUCGUA, UUCGUC, UUCGUG, UUCGUU, UUCUAC, UUCUAG, UUCUCA, UUCUCG, UUCUGG, UUCUUA, UUCUUU, UUGAAA, UUGAAC, UUGAAG, UUGAAU, UUGACC, UUGACG, UUGACU, UUGAGA, UUGAGC, UUGAGU, UUGAUA, UUGAUC, UUGAUG, UUGAUU, UUGCAA, UUGCAC, UUGCAG, UUGCAU, UUGCCC, UUGCCG, UUGCGA, UUGCGC, UUGCGG, UUGCGU, UUGCUA, UUGCUC, UUGCUG, UUGCUU, UUGGAA, UUGGAG, UUGGCC, UUGGCG, UUGGCU, UUGGGC, UUGGGU, UUGGUA, UUGGUG, UUGUAA, UUGUAC, UUGUCA, UUGUCG, UUGUCU, UUGUGC, UUGUGG, UUGUUA, UUGUUG, UUGUUU, UUUAAA, UUUAAC, UUUAAG, UUUAAU, UUUACA, UUUACC, UUUACG, UUUACU, UUUAGA, UUUAGC, UUUAGG, UUUAGU, UUUAUA, UUUAUC, UUUAUG, UUUAUU, UUUCAU, UUUCCA, UUUCCG, UUUCCU, UUUCGA, UUUCGC, UUUCGG, UUUCGU, UUUCUA, UUUCUC, UUUCUG, UUUCUU, UUUGAA, UUUGAC, UUUGAG, UUUGAU, UUUGCC, UUUGCU, UUUGGA, UUUGGC, UUUGGG, UUUGGU, UUUGUA, UUUGUC, UUUGUU, UUUUAA, UUUUAG, UUUUAU, UUUUCC, UUUUCG, UUUUCU, UUUUGA, UUUUGC, UUUUGG, UUUUGU, UUUUUA, UUUUUC, UUUUUU

TABLE 2

A listing of oligonucleotide modifications.

| Symbol | Feature Description |
|---|---|
| bio | 5' biotin |
| dAs | DNA w/3'thiophosphate |
| dCs | DNA w/3'thiophosphate |
| dGs | DNA w/3'thiophosphate |
| dTs | DNA w/3'thiophosphate |
| dG | DNA w/3'phosphate |
| dT | DNA w/3'phosphate |
| dU | deoxyuridine w/3'phosphate |
| d5mCs | deoxy-5-methylcytidine w/3'thiophosphate |
| enaAs | ENA w/3'thiophosphate |
| enaCs | ENA w/3'thiophosphate |
| enaGs | ENA w/3'thiophosphate |
| enaTs | ENA w/3'thiophosphate |
| fluAs | 2'-fluoro w/3'thiophosphate |
| fluCs | 2'-fluoro w/3'thiophosphate |
| fluGs | 2'-fluoro w/3'thiophosphate |
| fluUs | 2'-fluoro w/3'thiophosphate |
| lnaAs | LNA w/3'thiophosphate |
| lnaCs | LNA w/3'thiophosphate |
| lnaGs | LNA w/3'thiophosphate |
| lnaTs | LNA w/3'thiophosphate |
| omeAs | 2'-OMe w/3'thiophosphate |
| omeCs | 2'-OMe w/3'thiophosphate |
| omeGs | 2'-OMe w/3'thiophosphate |
| omeTs | 2'-OMe w/3'thiophosphate |
| lnaAs-Sup | LNA w/3'thiophosphate at 3'terminus |
| lnaCs-Sup | LNA w/3'thiophosphate at 3'terminus |
| lnaGs-Sup | LNA w/3'thiophosphate at 3'terminus |
| lnaTs-Sup | LNA w/3'thiophosphate at 3'terminus |
| lnaA-Sup | LNA w/3'OH at 3'terminus |
| lnaC-Sup | LNA w/3'OH at 3'terminus |
| lnaG-Sup | LNA w/3'OH at 3'terminus |
| lnaT-Sup | LNA w/3'OH at 3'terminus |
| omeA-Sup | 2'-OMe w/3'OH at 3'terminus |
| omeC-Sup | 2'-OMe w/3'OH at 3'terminus |
| omeG-Sup | 2'-OMe w/3'OH at 3'terminus |
| omeU-Sup | 2'-OMe w/3'OH at 3'terminus |
| dAs-Sup | DNA w/3'thiophosphate at 3'terminus |
| dCs-Sup | DNA w/3'thiophosphate at 3'terminus |
| dGs-Sup | DNA w/3'thiophosphate at 3'terminus |
| dTs-Sup | DNA w/3'thiophosphate at 3'terminus |
| dA-Sup | DNA w/3'OH at 3'terminus |
| dC-Sup | DNA w/3'OH at 3'terminus |
| dG-Sup | DNA w/3'OH at 3'terminus |
| dT-Sup | DNA w/3'OH at 3'terminus |
| dU | deoxyuridine w/3'OH at 3'terminus |
| rA | RNA w/3'phosphate |
| rC | RNA w/3'phosphate |
| rG | RNA w/3'phosphate |
| rU | RNA w/3'phosphate |

TABLE 3

Formatted oligonucleotide sequences made for testing in the lab showing nucleotide modifications.

| OligoID | Base Sequence | Formatted Sequence | SeqID |
|---|---|---|---|
| HBB-01 G7A m01 | GCTATTACCTTAACC CAG | InaGs; omeCs; InaTs; omeAs; InaTs; omeUs; InaAs; omeCs; InaCs; omeUs; InaTs; omeAs; InaAs; omeCs; InaCs; omeCs; InaAs; omeG-Sup | 3789 |
| HBB-02 m01 | GCTATTACCTTAACC | InaGs; omeCs; InaTs; omeAs; InaTs; omeUs; InaAs; omeCs; InaCs; omeUs; InaTs; omeAs; InaAs; omeCs; InaC-Sup | 3790 |
| HBB-03 m01 | CTATTACCTTAACCC | InaCs; omeUs; InaAs; omeUs; InaTs; omeAs; InaCs; omeCs; InaTs; omeUs; InaAs; omeAs; InaCs; omeCs; InaC-Sup | 3791 |
| HBB-04 m01 | TATTACCTTAACCCA | InaTs; omeAs; InaTs; omeUs; InaAs; omeCs; InaCs; omeUs; InaTs; omeAs; InaAs; omeCs; InaCs; omeCs; InaA-Sup | 3792 |
| HBB-05 m01 | ATTACCTTAACCCAG | InaAs; omeUs; InaTs; omeAs; InaCs; omeCs; InaTs; omeUs; InaAs; omeAs; InaCs; omeCs; InaCs; omeAs; InaG-Sup | 3793 |
| HBB-06 705 control m01 | CCTCTTACCTCAGTT ACA | InaCs; omeCs; InaTs; omeCs; InaTs; omeUs; InaAs; omeCs; InaCs; omeUs; InaCs; omeAs; InaGs; omeUs; InaTs; omeAs; InaCs; omeA-Sup | 3794 |
| HBB-01_G7A m01 | GCTATTACCTTAACC CAG | InaGs; omeCs; InaTs; omeAs; InaTs; omeUs; InaAs; omeCs; InaCs; omeUs; InaTs; omeAs; InaAs; omeCs; InaCs; omeCs; InaAs; omeG-Sup | 3789 |
| HBB-06 705 control m02 + bioTEGs + heg | CCTCTTACCTCAGTT ACA | InaCs; omeCs; InaTs; omeCs; InaTs; omeUs; InaAs; omeCs; InaCs; omeUs; InaCs; omeAs; InaGs; omeUs; InaTs; omeAs; InaCs; omeA-Sup | 3794 |
| HBB-01_G7A m01 | GCTATTACCTTAACC CAG | InaGs; omeCs; InaTs; omeAs; InaTs; omeUs; InaAs; omeCs; InaCs; omeUs; InaTs; omeAs; InaAs; omeCs; InaCs; omeCs; InaAs; omeG-Sup | 3789 |
| HBB-01_G7A dimer m1000 | GCTATTACCTTAACC CAGTTTTGCTATTAC CTTAACCCAG | InaGs; omeCs; InaTs; omeAs; InaTs; omeUs; InaAs; omeCs; InaCs; omeUs; InaTs; omeAs; InaAs; omeCs; InaCs; omeCs; InaAs; omeG; dT; dT; dT; dT; InaGs; omeCs; InaTs; omeAs; InaTs; omeUs; InaAs; omeCs; InaCs; omeCs; InaAs; omeG-Sup | 3795 |
| HBB-06 705 control m1000 | CCTCTTACCTCAGTT ACA | InaCs; omeCs; InaTs; omeCs; InaTs; omeUs; InaAs; omeCs; InaCs; omeUs; InaCs; omeAs; InaGs; omeUs; InaTs; omeAs; InaCs; omeA-Sup | 3794 |
| HBB-06 705 control dimer m1000 | CCTCTTACCTCAGTT ACATTTTCCTCTTAC CTCAGTTACA | InaCs; omeCs; InaTs; omeCs; InaTs; omeUs; InaAs; omeCs; InaCs; omeUs; InaCs; omeAs; InaGs; omeUs; InaTs; omeAs; InaCs; omeA; dT; dT; dT; dT; InaCs; omeCs; InaTs; omeCs; InaTs; omeUs; InaAs; omeCs; InaCs; omeUs; InaCs; omeAs; InaGs; omeUs; InaTs; omeAs; InaCs; omeA-Sup | 3796 |
| HBB-28 m08 | ACTTTTATGCCCAGC | InaAs; InaCs; InaTs; dTs; dTs; dTs; dAs; dTs; dGs; dCs; dCs; dCs; InaAs; InaGs; InaC-Sup | 3797 |
| HBB-29 m08 | TTTTATGCCCAGCCC | InaTs; InaTs; InaTs; dTs; dAs; dTs; dGs; dCs; dCs; dCs; dAs; dGs; InaCs; InaCs; InaC-Sup | 3798 |
| HBB-30 m08 | GTAGATTGGCCAACC | InaGs; InaTs; InaAs; dGs; dAs; dTs; dTs; dGs; dGs; dCs; dCs; dAs; InaAs; InaCs; InaC-Sup | 3799 |
| HBB-31 m08 | TAGATTGGCCAACCC | InaTs; InaAs; InaGs; dAs; dTs; dTs; dGs; dGs; dCs; dCs; dAs; dAs; InaCs; InaCs; InaC-Sup | 3800 |
| HBB-32 m08 | GATTGGCCAACCCTA | InaGs; InaAs; InaTs; dTs; dGs; dGs; dCs; dCs; dAs; dAs; dCs; dCs; InaCs; InaTs; InaA-Sup | 3801 |

TABLE 3-continued

Formatted oligonucleotide sequences made for testing
in the lab showing nucleotide modifications.

| OligoID | Base Sequence | Formatted Sequence | SeqID |
|---|---|---|---|
| HBB-33 m08 | ATTGGCCAACCCTAG | InaAs; InaTs; InaTs; dGs; dGs; dCs; dCs; dAs; dAs; dCs; dCs; dCs; InaTs; InaAs; InaG-Sup | 3802 |
| HBB-34 m08 | TGATGACAGCCGTAC | InaTs; InaGs; InaAs; dTs; dGs; dAs; dCs; dAs; dGs; dCs; dCs; dGs; InaTs; InaAs; InaC-Sup | 3803 |
| HBB-35 m08 | CAGCCGTACCTGTCC | InaCs; InaAs; InaGs; dCs; dCs; dGs; dTs; dAs; dCs; dCs; dTs; dGs; InaTs; InaCs; InaC-Sup | 3804 |
| HBB-36 m08 | CCGTACCTGTCCTTG | InaCs; InaCs; InaGs; dTs; dAs; dCs; dCs; dTs; dGs; dTs; dCs; dCs; InaTs; InaTs; InaG-Sup | 3805 |
| HBB-37 m08 | CGTACCTGTCCTTGG | InaCs; InaGs; InaTs; dAs; dCs; dCs; dTs; dGs; dTs; dCs; dCs; dTs; InaTs; InaGs; InaG-Sup | 3806 |
| HBB-38 m08 | TTCTGGCACTGGCTT | InaTs; InaTs; InaCs; dTs; dGs; dGs; dCs; dAs; dCs; dTs; dGs; dGs; InaCs; InaTs; InaT-Sup | 3807 |
| HBB-39 m08 | GCACTGGCTTAGGAG | InaGs; InaCs; InaAs; dCs; dTs; dGs; dGs; dCs; dTs; dTs; dAs; dGs; InaGs; InaAs; InaG-Sup | 3808 |
| HBB-40 m08 | GCTCTTCTGGCACTG GCTTAGGAGT | InaGs; InaCs; InaTs; dCs; dTs; dTs; dCs; dTs; dGs; dGs; dCs; dAs; dCs; dTs; dGs; dGs; dCs; dTs; dTs; dAs; dGs; dGs; InaAs; InaGs; InaT-Sup | 3809 |
| HBB-41 m08 | TCTGGCACTGGCTTA GGAGTTGGAC | InaTs; InaCs; InaTs; dGs; dGs; dCs; dAs; dCs; dTs; dGs; dGs; dCs; dTs; dTs; dAs; dGs; dGs; dAs; dGs; dTs; dTs; dGs; InaGs; InaAs; InaC-Sup | 3810 |
| HBB-42 m08 | GCACTGGCTTAGGAG TTGGACTTCA | InaGs; InaCs; InaAs; dCs; dTs; dGs; dGs; dCs; dTs; dTs; dAs; dGs; dGs; dAs; dGs; dTs; dTs; dGs; dGs; dAs; dCs; dTs; InaTs; InaCs; InaA-Sup | 3811 |
| HBB-43 m08 | ATCGTTTTCCCAATT | InaAs; InaTs; InaCs; dGs; dTs; dTs; dTs; dTs; dCs; dCs; dCs; dAs; InaAs; InaTs; InaT-Sup | 3812 |
| HBB-44 m08 | AAAACTCTACCTCGG | InaAs; InaAs; InaAs; dAs; dCs; dTs; dCs; dTs; dAs; dCs; dCs; dTs; InaCs; InaGs; InaG-Sup | 3813 |
| HBB-45 m08 | ACCTCGGTTCTAAGC | InaAs; InaCs; InaCs; dTs; dCs; dGs; dGs; dTs; dTs; dCs; dTs; dAs; InaAs; InaGs; InaC-Sup | 3814 |
| HBB-46 m08 | GCTCTGTGCATTAGT | InaGs; InaCs; InaTs; dCs; dTs; dGs; dTs; dGs; dCs; dAs; dTs; dTs; InaAs; InaGs; InaT-Sup | 3815 |
| HBB-47 m08 | AATAGGAGGTTAACT | InaAs; InaAs; InaTs; dAs; dGs; dGs; dAs; dGs; dGs; dTs; dTs; dAs; InaAs; InaCs; InaT-Sup | 3816 |
| HBB-48 m08 | GGTCTTCTACTTGGC | InaGs; InaGs; InaTs; dCs; dTs; dTs; dCs; dTs; dAs; dCs; dTs; dTs; InaGs; InaGs; InaC-Sup | 3817 |
| HBB-49 m08 | GCTGCAAGCTATACT | InaGs; InaCs; InaTs; dGs; dCs; dAs; dAs; dGs; dCs; dTs; dAs; dTs; InaAs; InaCs; InaT-Sup | 3818 |
| HBB-50 m08 | GGTGCAGGTCTATTC | InaGs; InaGs; InaTs; dGs; dCs; dAs; dGs; dGs; dTs; dCs; dTs; dAs; InaTs; InaTs; InaC-Sup | 3819 |

TABLE 3-continued

Formatted oligonucleotide sequences made for testing
in the lab showing nucleotide modifications.

| OligoID | Base Sequence | Formatted Sequence | SeqID |
|---|---|---|---|
| HBB-51 m08 | CCTCTAAGTATACCC | InaCs; InaCs; InaTs; dCs; dTs; dAs; dAs; dGs; dTs; dAs; dTs; dAs; InaCs; InaCs; InaC-Sup | 3820 |
| HBB-52 m08 | GCTTGACCTAGGAAC | InaGs; InaCs; InaTs; dTs; dGs; dAs; dCs; dCs; dTs; dAs; dGs; dGs; InaAs; InaAs; InaC-Sup | 3821 |
| HBB-53 m08 | AACCAGAACCCATAG | InaAs; InaAs; InaCs; dCs; dAs; dGs; dAs; dAs; dCs; dCs; dCs; dAs; InaTs; InaAs; InaG-Sup | 3822 |
| HBB-54 m08 | GAAACAAACCGCACA | InaGs; InaAs; InaAs; dAs; dCs; dAs; dAs; dAs; dCs; dCs; dGs; dCs; InaAs; InaCs; InaA-Sup | 3823 |
| HBB-55 m08 | CGAATACCACACAAG | InaCs; InaGs; InaAs; dAs; dTs; dAs; dCs; dCs; dAs; dCs; dAs; dCs; InaAs; InaAs; InaG-Sup | 3824 |
| HBB-56 m08 | TACTTGTGACCTCTC | InaTs; InaAs; InaCs; dTs; dTs; dGs; dTs; dGs; dAs; dCs; dCs; dTs; InaCs; InaTs; InaC-Sup | 3825 |
| HBB-57 m08 | CTATACCCCATCAAG | InaCs; InaTs; InaAs; dTs; dAs; dCs; dCs; dCs; dCs; dAs; dTs; dCs; InaAs; InaAs; InaG-Sup | 3826 |
| HBB-58 m08 | GTTGGAGTTTAATCG | InaGs; InaTs; InaTs; dGs; dGs; dAs; dGs; dTs; dTs; dTs; dAs; dAs; InaTs; InaCs; InaG-Sup | 3827 |
| HBB-59 m08 | TTGGAGTTTAATCGT | InaTs; InaTs; InaGs; dGs; dAs; dGs; dTs; dTs; dTs; dAs; dAs; dTs; InaCs; InaGs; InaT-Sup | 3828 |
| HBB-60 m08 | GGAGTTTAATCGTAG | InaGs; InaGs; InaAs; dGs; dTs; dTs; dTs; dAs; dAs; dTs; dCs; dGs; InaTs; InaAs; InaG-Sup | 3829 |
| HBB-61 m08 | GAGTTTAATCGTAGC | InaGs; InaAs; InaGs; dTs; dTs; dTs; dAs; dAs; dTs; dCs; dGs; dTs; InaAs; InaGs; InaC-Sup | 3830 |
| HBB-62 m08 | AGTTTAATCGTAGCA | InaAs; InaGs; InaTs; dTs; dTs; dAs; dAs; dTs; dCs; dGs; dTs; dAs; InaGs; InaCs; InaA-Sup | 3831 |
| HBB-63 m08 | GTTTAATCGTAGCAT | InaGs; InaTs; InaTs; dTs; dAs; dAs; dTs; dCs; dGs; dTs; dAs; dGs; InaCs; InaAs; InaT-Sup | 3832 |
| HBB-64 m08 | TTAATCGTAGCATTA | InaTs; InaTs; InaAs; dAs; dTs; dCs; dGs; dTs; dAs; dGs; dCs; dAs; InaTs; InaTs; InaA-Sup | 3833 |
| HBB-65 m08 | TAATCGTAGCATTAC | InaTs; InaAs; InaAs; dTs; dCs; dGs; dTs; dAs; dGs; dCs; dAs; dTs; InaTs; InaAs; InaC-Sup | 3834 |
| HBB-65 m08 | AATCGTAGCATTACC | InaAs; InaAs; InaTs; dCs; dGs; dTs; dAs; dGs; dCs; dAs; dTs; dTs; InaAs; InaCs; InaC-Sup | 3835 |
| HBB-67 m08 | ATCGTAGCATTACCC | InaAs; InaTs; InaCs; dGs; dTs; dAs; dGs; dCs; dAs; dTs; dTs; dAs; InaCs; InaCs; InaC-Sup | 3836 |
| HBB-68 m08 | CGTAGCATTACCCTT | InaCs; InaGs; InaTs; dAs; dGs; dCs; dAs; dTs; dTs; dAs; dCs; dCs;l naCs; InaTs; InaT-Sup | 3837 |
| HBB-69 m08 | GTAGCATTACCCTTG | InaGs; InaTs; InaAs; dGs; dCs; dAs; dTs; dTs; dAs; dCs; dCs; dCs; InaTs; InaTs; InaG-Sup | 3838 |

TABLE 3-continued

Formatted oligonucleotide sequences made for testing in the lab showing nucleotide modifications.

| OligoID | Base Sequence | Formatted Sequence | SeqID |
|---|---|---|---|
| HBB-70 m08 | GTTGAGGTCTTCCCT | InaGs; InaTs; InaTs; dGs; dAs; dGs; dGs; dTs; dCs; dTs; dTs; dCs; InaCs; InaCs; InaT-Sup | 3839 |
| HBB-71 m08 | TTAATGCCTTGTACG | InaTs; InaTs; InaAs; dAs; dTs; dGs; dCs; dCs; dTs; dTs; dGs; dTs; InaAs; InaCs; InaG-Sup | 3840 |
| HBB-72 m08 | TAATGCCTTGTACGG | InaTs; InaAs; InaAs; dTs; dGs; dCs; dCs; dTs; dTs; dGs; dTs; dAs; InaCs; InaGs; InaG-Sup | 3841 |
| HBB-73 m08 | TGCCTTGTACGGTTC | InaTs; InaGs; InaCs; dCs; dTs; dTs; dGs; dTs; dAs; dCs; dGs; dGs; InaTs; InaTs; InaC-Sup | 3842 |
| HBB-74 m08 | GCCTTGTACGGTTCC | InaGs; InaCs; InaCs; dTs; dTs; dGs; dTs; dAs; dCs; dGs; dGs; dTs; InaTs; InaCs; InaC-Sup | 3843 |
| HBB-75 m08 | CCTTGTACGGTTCCC | InaCs; InaCs; InaTs; dTs; dGs; dTs; dAs; dCs; dGs; dGs; dTs; dTs; InaCs; InaCs; InaC-Sup | 3844 |
| HBB-76 m08 | CTTGTACGGTTCCCT | InaCs; InaTs; InaTs; dGs; dTs; dAs; dCs; dGs; dGs; dTs; dTs; dCs; InaCs; InaCs; InaT-Sup | 3845 |
| HBB-77 m08 | TGTACGGTTCCCTTG | InaTs; InaGs; InaTs; dAs; dCs; dGs; dGs; dTs; dTs; dCs; dCs; dCs; InaTs; InaTs; InaG-Sup | 3846 |
| HBB-78 m08 | GTACGGTTCCCTTGC | InaGs; InaTs; InaAs; dCs; dGs; dGs; dTs; dTs; dCs; dCs; dCs; dTs; InaTs; InaGs; InaC-Sup | 3847 |
| HBB-79 m08 | CAAGTGCTCCCTATC | InaCs; InaAs; InaAs; dGs; dTs; dGs; dCs; dTs; dCs; dCs; dCs; dTs; InaAs; InaTs; InaC-Sup | 3848 |
| HBB-80 m08 | GCTCCCTATCTGTAG | InaGs; InaCs; InaTs; dCs; dCs; dCs; dTs; dAs; dTs; dCs; dTs; dGs; InaTs; InaAs; InaG-Sup | 3849 |
| HBB-07 m13 | GCCATCTATTGCTTACATT | rG; rC; rC; rA; rU; rC; rU; rA; rU; rU; rG; rC; rU; rU; rA7C; rA; rU; rU; dU; dU-Sup | 3850 |
| HBB-08 m13 | CCATCTATTGCTTACATTT | rC; rC; rA; rU; rC; rU; rA; rU; rU; rG; rC; rU; rU; rA7C; rA; rU; rU; rU; dU; dU-Sup | 3851 |
| HBB-09 m13 | CATCTATTGCTTACATTTG | rC; rA; rU; rC; rU; rA; rU; rU; rG; rC; rU; rU; rA; rC; rA; rU; rU; rU; rG; dU; dU-Sup | 3852 |
| HBB-10 m13 | ATCTATTGCTTACATTTGC | rA; rU; rC; rU; rA; rU; rU; rG; rC; rU; rU; rA; rC; rA; rU; rU; rU; rG; rC; dU; dU-Sup | 3853 |
| HBB-11 m13 | TCTATTGCTTACATTTGCT | rU; rC; rU; rA; rU; rU; rG; rC; rU; rU; rA; rC; rA; rU; rU; rU; rG; rC; rU; dU; dU-Sup | 3854 |
| HBB-12 m13 | CTATTGCTTACATTTGCTT | rC; rU; rA; rU; rU; rG; rC; rU; rU; rA; rC; rA; rU; rU; rU; rG; rC; rU; rU; dU; dU-Sup | 3855 |
| HBB-13 m13 | TATTGCTTACATTTGCTTC | rU; rA; rU; rU; rG; rC; rU; rU; rA; rC; rA; rU; rU; rU; rG; rC; rU; rU; rC; dU; dU-Sup | 3856 |
| HBB-14 m13 | ATTGCTTACATTTGCTTCT | rA; rU; rU; rG; rC; rU; rU; rA; rC; rA; rU; rU; rU; rG; rC; rU; rU; rC; rU; dU; dU-Sup | 3857 |

TABLE 3-continued

Formatted oligonucleotide sequences made for testing
in the lab showing nucleotide modifications.

| OligoID | Base Sequence | Formatted Sequence | SeqID |
|---|---|---|---|
| HBB-15 m13 | TTGCTTACATTTGCT TCTG | rU; rU; rG; rC; rU; rU; rA; rC; rA; rU; rU; rU; rG; rC; rU; rU; rC; rU; rG; dU; dU-Sup | 3858 |
| HBB-16 m13 | TGCTTACATTTGCTT CTGA | rU; rG; rC; rU; rU; rA; rC; rA; rU; rU; rU; rG; rC; rU; rU; rC; rU; rG; rA; dU; dU-Sup | 3859 |
| HBB-17 m13 | GCTTACATTTGCTTC TGAC | rG; rC; rU; rU; rA; rC; rA; rU; rU; rU; rG; rC; rU; rU; rC; rU; rG; rA; rC; dU; dU-Sup | 3860 |
| HBB-18 m13 | CTTACATTTGCTTCT GACA | rC; rU; rU; rA; rC; rA; rU; rU; rU; rG; rC; rU; rU; rC; rU; rG; rA; rC; rA; dU; dU-Sup | 3861 |
| HBB-19 m13 | TTACATTTGCTTCTG ACAC | rU; rU; rA; rC; rA; rU; rU; rU; rG; rC; rU; rU; rC; rU; rG; rA; rC; rA; rC; dU; dU-Sup | 3862 |
| HBB-20 m13 | TACATTTGCTTCTGA CACA | rU; rA; rC; rA; rU; rU; rU; rG; rC; rU; rU; rC; rU; rG; rA7C; rA; rC; rA; dU; dU-Sup | 3863 |
| HBB-21 m13 | ACATTTGCTTCTGAC ACAA | rA; rC; rA; rU; rU; rU; rG; rC; rU; rU; rC; rU; rG; rA; rC; rA; rC; rA; rA; dU; dU-Sup | 3864 |
| HBB-22 m13 | CATTTGCTTCTGACA CAAC | rC; rA; rU; rU; rU; rG; rC; rU; rU; rC; rU; rG; rA; rC; rA7C; rA; rA; rC; dU; dU-Sup | 3865 |
| HBB-23 m13 | ATTTGCTTCTGACAC AACT | rA; rU; rU; rU; rG; rC; rU; rU; rC; rU; rG; rA; rC; rA; rC; rA; rA; rC; rU; dU; dU-Sup | 3866 |
| HBB-24 m13 | TTTGCTTCTGACACA ACTG | rU; rU; rU; rG; rC; rU; rU; rC; rU; rG; rA; rC; rA7C; rA; rA; rC; rU; rG; dU; dU-Sup | 3867 |
| HBB-25 m13 | TTGCTTCTGACACAA CTGT | rU; rU; rG; rC; rU; rU; rC; rU; rG; rA; rC; rA; rC; rA; rA; rC; rU; rG; rU; dU; dU-Sup | 3868 |
| HBB-26 m13 | TGCTTCTGACACAAC TGTG | rU; rG; rC; rU; rU; rC; rU; rG; rA; rC; rA; rC; rA; rA; rC; rU; rG; rU; rG; dU; dU-Sup | 3869 |
| HBB-27 m13 | CACAACTGTGTTCAC TAGC | rC; rA; rC; rA; rA; rC; rU; rG; rU; rG; rU; rU; rC; rA; rC; rU; rA; rG; rC; dU; dU-Sup | 3870 |
| HBG2-01 m13 | AGGGCAAAGAACAGG TGGG | rA; rG; rG; rG; rC; rA; rA; rA; rG; rA; rA; rC; rA; rG; rG; rU; rG; rG; rG; dU; dU-Sup | 3871 |
| HBG2-02 m13 | GGCAAAGAACAGGTG GAA | rG; rG; rC; rA; rA; rA; rG; rA; rA; rC; rA; rG; rG; rU; rG; rG; rA; rA; dU; dU-Sup | 3872 |
| HBG2-03 m13 | GCAAAGAACAGGTGG GAAT | rG; rC; rA; rA; rA; rG; rA; rA; rC; rA; rG; rG; rU; rG; rG; rG; rA; rA; rU; dU; dU-Sup | 3873 |
| HBG2-04 m13 | AGAACAGGTGGGAAT GTAT | rA; rG; rA; rA; rC; rA; rG; rG; rU; rG; rG; rG; rA; rA; rU; rG; rU; rA; rU; dU; dU-Sup | 3874 |
| HBG2-05 m13 | GGGAATGTATCCAGA GAAT | rG; rG; rG; rA; rA; rU; rG; rU; rA; rU; rC; rC; rA; rG; rA; rG; rA; rA; rU; dU; dU-Sup | 3875 |
| HBG2-06 m13 | GGAATGTATCCAGAG AATC | rG; rG; rA; rA; rU; rG; rU; rA; rU; rC; rC; rA; rG; rA; rG; rA; rA; rU; rC; dU; dU-Sup | 3876 |

TABLE 3-continued

Formatted oligonucleotide sequences made for testing
in the lab showing nucleotide modifications.

| OligoID | Base Sequence | Formatted Sequence | SeqID |
|---|---|---|---|
| HBG2-07 m13 | GAATGTATCCAGAGAATCA | rG; rA; rA; rU; rG; rU; rA; rU; rC; rC; rA; rG; rA; rG; rA; rA; rU; rC; rA; dU; dU-Sup | 3877 |
| HBG2-08 m13 | AATGTATCCAGAGAATCAA | rA; rA; rU; rG; rU; rA; rU; rC; rC; rA; rG; rA; rG; rA; rA; rU; rC; rA; rA; dU; dU-Sup | 3878 |
| HBG2-09 m13 | ATGTATCCAGAGAATCAAC | rA; rU; rG; rU; rA; rU; rC; rC; rA; rG; rA; rG; rA; rA; rU; rC; rA; rA; rC; dU; dU-Sup | 3879 |
| HBG2-10 m13 | TGTATCCAGAGAATCAACA | rU; rG; rU; rA; rU; rC; rC; rA; rG; rA; rG; rA; rA; rU; rC; rA; rA; rC; rA; dU; dU-Sup | 3880 |
| HBG2-11 m13 | GTATCCAGAGAATCAACAT | rG; rU; rA; rU; rC; rC; rA; rG; rA; rG; rA; rA; rU; rC; rA; rA; rC; rA; rU; dU; dU-Sup | 3881 |
| HBG2-12 m13 | TATCCAGAGAATCAACATA | rU; rA; rU; rC; rC; rA; rG; rA; rG; rA; rA; rU; rC; rA; rA; rC; rA; rU; rA; dU; dU-Sup | 3882 |
| HBG2-13 m13 | ATCCAGAGAATCAACATAC | rA; rU; rC; rC; rA; rG; rA; rG; rA; rA; rU; rC; rA; rA; rC; rA; rU; rA; rC; dU; dU-Sup | 3883 |
| HBG2-14 m13 | TCCAGAGAATCAACATACA | rU; rC; rC; rA; rG; rA; rG; rA; rA; rU; rC; rA; rA; rC; rA; rU; rA; rC; rA; dU; dU-Sup | 3884 |
| HBG2-15 m13 | AGAGAATCAACATACAATG | rA; rG; rA; rG; rA; rA; rU; rC; rA; rA; rC; rA; rU; rA; rC; rA; rA; rU; rG; dU; dU-Sup | 3885 |
| HBG2-16 m13 | AGAATCAACATACAATGAG | rA; rG; rA; rA; rU; rC; rA; rA; rC; rA; rU; rA; rC; rA; rA; rU; rG; rA; rG; dU; dU-Sup | 3886 |
| HBG2-17 m13 | GAATCAACATACAATGAGC | rG; rA; rA; rU; rC; rA; rA; rC; rA; rU; rA; rC; rA; rA; rU; rG; rA; rG; rC; dU; dU-Sup | 3887 |
| HBG2-18 m13 | AATCAACATACAATGAGCA | rA; rA; rU; rC; rA; rA; rC; rA; rU; rA; rC; rA; rA; rU; rG; rA; rG; rC; rA; dU; dU-Sup | 3888 |
| HBG2-19 m13 | ATCAACATACAATGAGCAA | rA; rU; rC; rA; rA; rC; rA; rU; rA; rC; rA; rA; rU; rG; rA; rG; rC; rA; rA; dU; dU-Sup | 3889 |
| HBG2-20 m13 | TCAACATACAATGAGCAAA | rU; rC; rA; rA; rC; rA; rU; rA; rC; rA; rA; rU; rG; rA; rG; rC; rA; rA; rA; dU; dU-Sup | 3890 |
| HBG2-21 m13 | CAACATACAATGAGCAAAA | rC; rA; rA; rC; rA; rU; rA; rC; rA; rA; rU; rG; rA; rG; rC; rA; rA; rA; rA; dU; dU-Sup | 3891 |
| HBG2-22 m13 | AACATACAATGAGCAAAAG | rA; rA; rC; rA; rU; rA; rC; rA; rA; rU; rG; rA; rG; rC; rA; rA; rA; rA; rG; dU; dU-Sup | 3892 |
| HBG2-23 m13 | GGAAGCACCCTTCAGCAGT | rG; rG; rA; rA; rG; rC; rA; rC; rC; rC; rU; rU; rC; rA; rG; rC; rA; rG; rU; dU; dU-Sup | 3893 |
| HBG2-24 m13 | GAAGCACCCTTCAGCAGTT | rG; rA; rA; rG; rC; rA; rC; rC; rC; rU; rU; rC; rA; rG; rC; rA; rG; rU; rU; dU; dU-Sup | 3894 |
| HBG2-25 m13 | AGCACCCTTCAGCAGTTCC | rA; rG; rC; rA; rC; rC; rC; rU; rU; rC; rA; rG; rC; rA; rG; rU; rU; rC; rC; dU; dU-Sup | 3895 |

TABLE 3-continued

Formatted oligonucleotide sequences made for testing in the lab showing nucleotide modifications.

| OligoID | Base Sequence | Formatted Sequence | SeqID |
|---|---|---|---|
| HBG2-26 m13 | GCACCCTTCAGCAGT TCCA | rG; rC; rA; rC; rC; rC; rU; rU; rC; rA; rG; rC; rA; rG; rU; rU; rC; rC; rA; dU; dU-Sup | 3896 |
| HBG2-27 m13 | CACCCTTCAGCAGTT CCAC | rC; rA; rC; rC; rC; rU; rU; rC; rA; rG; rC; rA; rG; rU; rU; rC; rC; rA; rC; dU; dU-Sup | 3897 |
| HBG2-28 m13 | ACCCTTCAGCAGTTC CACA | rA; rC; rC; rC; rU; rU; rC; rA; rG; rC; rA; rG; rU; rU; rC; rC; rA; rC; rA; dU; dU-Sup | 3898 |
| HBG2-29 m13 | CCCTTCAGCAGTTCC ACAC | rC; rC; rC; rU; rU; rC; rA; rG; rC; rA; rG; rU; rU; rC; rC; rA; rC; rA; rC; dU; dU-Sup | 3899 |
| HBG2-30 m13 | CCTTCAGCAGTTCCA CACA | rC; rC; rU; rU; rC; rA; rG; rC; rA; rG; rU; rC; rC; rA; rC; rA; rC; rA; rC; dU; dU-Sup | 3900 |
| HBG2-31 m13 | CTTCAGCAGTTCCAC ACAC | rC; rU; rU; rC; rA; rG; rC; rA; rG; rU; rU; rC; rC; rA; rC; rA; rC; rA; rC; dU; dU-Sup | 3901 |
| HBG2-32 m13 | TTCAGCAGTTCCACA CACT | rU; rU; rC; rA; rG; rC; rA; rG; rU; rU; rC; rC; rA; rC; rA; rC; rA; rC; rU; dU; dU-Sup | 3902 |
| HBG2-33 m13 | CAGCAGTTCCACACA CTCG | rC; rA; rG; rC; rA; rG; rU; rU; rC; rC; rA; rC; rA; rC; rA; rC; rU; rC; rG; dU; dU-Sup | 3903 |
| HBG2-34 m13 | AGCAGTTCCACACAC TCGC | rA; rG; rC; rA; rG; rU; rU; rC; rC; rA; rC; rA; rC; rA; rC; rU; rC; rG; rC; dU; dU-Sup | 3904 |
| HBG2-35 m13 | GCAGTTCCACACACT CGCT | rG; rC; rA; rG; rU; rU; rC; rC; rA; rC; rA; rC; rA; rC; rU; rC; rG; rC; rU; dU; dU-Sup | 3905 |
| HBG2-36 m13 | CAGTTCCACACACTC GCTT | rC; rA; rG; rU; rU; rC; rC; rA; rC; rA; rC; rA; rC; rU; rC; rG; rC; rU; rU; dU; dU-Sup | 3906 |
| HBG2-37 m13 | AGTTCCACACACTCG CTTC | rA; rG; rU; rU; rC; rC; rA; rC; rA; rC; rA; rC; rU; rC; rG; rC; rU; rU; rC; dU; dU-Sup | 3907 |
| HBG2-38 m13 | GTTCCACACACTCGC TTCT | rG; rU; rU; rC; rC; rA; rC; rA; rC; rA; rC; rU; rC; rG; rC; rU; rU; rC; rU; dU; dU-Sup | 3908 |
| HBG2-39 m13 | TTCCACACACTCGCT TCTG | rU; rU; rC; rC; rA; rC; rA; rC; rA; rC; rU; rC; rG; rC; rU; rU; rC; rU; rG; dU; dU-Sup | 3909 |
| HBG2-40 m13 | TCCACACACTCGCTT CTGG | rU; rC; rC; rA; rC; rA; rC; rA; rC; rU; rC; rG; rC; rU; rU; rC; rU; rG; rG; dU; dU-Sup | 3910 |
| HBG2-41 m13 | CCACACACTCGCTTC TGGA | rC; rC; rA; rC; rA; rC; rA; rC; rU; rC; rG; rC; rU; rU; rC; rU; rG; rG; rA; dU; dU-Sup | 3911 |
| HBG2-42 m13 | ACACACTCGCTTCTG GAAC | rA; rC; rA; rC; rA; rC; rU; rC; rG; rC; rU; rU; rC; rU; rG; rG; rA; rA; rC; dU; dU-Sup | 3912 |
| HBG2-43 m13 | CACACTCGCTTCTGG AACG | rC; rA; rC; rA; rC; rU; rC; rG; rC; rU; rU; rC; rU; rG; rG; rA; rA; rC; rG; dU; dU-Sup | 3913 |
| HBG2-44 m13 | ACACTCGCTTCTGGA ACGT | rA; rC; rA; rC; rU; rC; rG; rC; rU; rU; rC; rU; rG; rG; rA; rA; rC; rG; rU; dU; dU-Sup | 3914 |

TABLE 3-continued

Formatted oligonucleotide sequences made for testing in the lab showing nucleotide modifications.

| OligoID | Base Sequence | Formatted Sequence | SeqID |
|---|---|---|---|
| HBG2-45 m13 | CACTCGCTTCTGGAA CGTC | rC; rA; rC; rU; rC; rG; rC; rU; rU; rC; rU; rG; rG; rA; rA; rC; rG; rU; rC; dU; dU-Sup | 3915 |
| HBG2-46 m13 | ACTCGCTTCTGGAAC GTCT | rA; rC; rU; rC; rG; rC; rU; rU; rC; rU; rG; rG; rA; rA; rC; rG; rU; rC; rU; dU; dU-Sup | 3916 |
| HBB-01_G7A dimer m1000 | GCTATTACCTTAACC CAGTTTTGCTATTAC CTTAACCCAG | InaGs; omeCs; InaTs; omeAs; InaTs; omeUs; InaAs; omeCs; InaCs; omeUs; InaTs; omeAs; InaAs; omeCs; InaCs; omeCs; InaAs; omeG; dT; dT; dT; dT; InaGs; omeCs; InaTs; omeAs; InaTs; omeUs; InaAs; omeCs; InaCs; omeUs; InaTs; omeAs; InaAs; omeCs; InaCs; omeCs; InaAs; omeG-Sup | 3795 |
| HBB-06 705 control dimer | CCTCTTACCTCAGTT ACATTTTCCTCTTAC CTCAGTTACA | InaCs; omeCs; InaTs; omeCs; InaTs; omeUs; InaAs; omeCs; InaCs; omeUs; InaCs; omeAs; InaGs; omeUs; InaTs; omeAs; InaCs; omeA; dT; dT; dT; dT; InaCs; omeCs; InaTs; omeCs; InaTs; omeUs; InaAs; omeCs; InaCs; omeUs; InaCs; omeAs; InaGs; omeUs; InaTs; omeAs; InaCs; omeA-Sup | 3796 |

BRIEF DESCRIPTION OF THE SEQUENCE LISTING

| SEQ ID | Chrom | Gene | Chr. Start | Chr. End | Strand |
|---|---|---|---|---|---|
| 1 | chr11 | HBB | 5234695 | 5260301 | − |
| 2 | chr11 | HBB | 5234695 | 5260301 | + |
| 3 | chr11 | HBD | 5242058 | 5267858 | − |
| 4 | chr11 | HBD | 5242058 | 5267858 | + |
| 5 | chr11 | HBE1 | 5277579 | 5303373 | − |
| 6 | chr11 | HBE1 | 5277579 | 5303373 | + |
| 7 | chr11 | HBG1 | 5257501 | 5283087 | − |
| 8 | chr11 | HBG1 | 5257501 | 5283087 | + |
| 9 | chr11 | HBG2 | 5262420 | 5288011 | − |
| 10 | chr11 | HBG2 | 5262420 | 5288011 | + |
| 11 | chr7 | Hbb-b1 | 110949041 | 110974437 | − |
| 12 | chr7 | Hbb-b1 | 110949041 | 110974437 | + |
| 13 | chr7 | Hbb-bh1 | 110978151 | 111003676 | − |
| 14 | chr7 | Hbb-bh1 | 110978151 | 111003676 | + |
| 15 | chr7 | Hbb-y | 110988267 | 111013721 | − |
| 16 | chr7 | Hbb-y | 110988267 | 111013721 | + |
| 17 | chr11 | HBB/HBD | 5246366 | 5246414 | + |
| 18 | chr11 | HBB/HBD | 5244366 | 5248414 | + |

Single Strand Oligonucleotides (Sense Strand of Target Gene)
SeqID range: 19-3788, 3820-3821, 3825-3826, 3850-3916
SeqIDs w/o G Runs:
19-50, 64-77, 112, 126-187, 201-253, 266-322, 327-358, 368-382, 401-445, 473-475, 489-808, 822-856, 870-955, 969-1021, 1035-1148, 1162-1232, 1246-1402, 1431-1508, 1530-1568, 1582-1956, 1971-2079, 2093-2481, 2495-2511, 2525-2580, 2594-3075, 3101-3114, 3128-3136, 3150-3309, 3323-3344, 3358-3399, 3414-3443, 3461-3467, 3481-3532, 3546-3788, 3820-3821, 3825-3826, 3850-3870, 3876-3916
SeqIDs w/o miR Seeds:
19, 22-26, 28-29, 31-32, 34-37, 39, 44, 46-47, 49, 51-52, 54, 56-60, 62, 64-65, 68-76, 78, 90, 99, 109, 111-113, 115, 119-120, 125, 128-136, 138-141, 143-149, 156, 160-162, 164-165, 172, 175-176, 178, 181-189, 194, 199, 204-206, 208-211, 215-216, 221-224, 227, 230-234, 237, 239, 242-243, 245, 247, 251-252, 254-258, 261, 263, 266, 270, 275-276, 279, 281-284, 286, 288-294, 296, 299, 301-303, 305, 308, 310-315, 318, 320, 326-332, 334, 336, 338-340, 342, 345-348, 352-353, 355-356, 358-361, 363-364, 366, 368-370, 372-373, 376-381, 383, 385-387, 389, 392, 394-395, 397, 400-408, 410-415, 419, 421, 424-428, 430-431, 434-438, 442-447, 449-451, 456, 458-463, 466-473, 475, 477-482, 485-486, 490-502, 504-505, 507, 516-517, 519-521, 523-524, 526-550, 552, 554-579, 581, 583-586, 588-599, 601, 604-610, 612-613, 615-619, 621-628, 632-635, 639, 641, 643, 646-649, 651-655, 658-662, 668-673, 675-679, 681-684, 686-691, 694-699, 701, 703, 705, 708-709, 711, 713-716, 718-722, 724, 726-727, 729-730, 733-736, 738, 741-746, 748, 750, 753, 755-759, 761, 764, 766, 768-801, 803, 805-806, 808-809, 812-816, 818, 820-824, 828, 830-831, 834-838, 841-844, 847, 850, 853-860, 864, 866-867, 869-870, 873-874, 876, 878-882, 884, 887-892, 895-898, 900-901, 903, 905-910, 913-916, 918-919, 921-928, 930-935, 937-938, 941-943, 947-951, 956-961, 963, 967-977, 979-986, 988-989, 991, 995-996, 998, 1001, 1003-1005, 1009, 1012-1016, 1018, 1023-1024, 1026-1029, 1031, 1033-1035, 1037, 1039-1044, 1047, 1049-1051, 1054-1055, 1058-1059, 1062-1069, 1071, 1074-1075, 1078-1088, 1090, 1093-1097, 1100-1103, 1106, 1108-1109, 1111-1112, 1114-1115, 1120, 1123-1126, 1131-1134, 1136-1137, 1141-1142, 1144-1152, 1155, 1160-1165, 1170-1172, 1174-1175, 1181-1189, 1195-1200, 1202-1205, 1207-1210, 1212, 1214, 1217, 1219-1223, 1225-1226, 1229, 1232-1237, 1243-1244, 1247-1252, 1255, 1257-1259, 1261, 1263-1264, 1270-1272, 1274-1276, 1278, 1280, 1282-1283, 1286-1287, 1289-1293, 1296, 1298, 1304-1306, 1308, 1311-

1314, 1316, 1318-1319, 1322, 1330-1332, 1334, 1336-1339, 1341-1345, 1347-1349, 1353-1354, 1356-1359, 1361-1369, 1371-1372, 1374-1376, 1378-1380, 1382-1383, 1385-1386, 1388, 1391-1401, 1403-1408, 1411, 1416, 1421-1424, 1427, 1430, 1432-1439, 1443, 1445, 1449-1455, 1457-1458, 1460-1461, 1463, 1465-1469, 1471-1473, 1476, 1478-1480, 1482, 1484-1492, 1495-1498, 1500, 1503-1507, 1509-1517, 1522-1523, 1530-1532, 1537, 1539, 1541-1546, 1548-1549, 1551, 1553, 1555, 1557-1558, 1560-1562, 1564-1567, 1569, 1573-1574, 1579, 1582-1587, 1589, 1591-1594, 1596, 1598-1601, 1605-1607, 1609, 1611, 1615, 1618, 1622, 1625-1629, 1631-1633, 1637, 1639-1642, 1644, 1646, 1648-1649, 1655, 1657-1658, 1661-1663, 1666-1671, 1673-1675, 1677-1679, 1681-1686, 1690, 1699, 1701-1707, 1709-1710, 1715-1718, 1720-1721, 1723-1726, 1728-1729, 1731, 1734-1737, 1739-1741, 1743-1749, 1751-1759, 1761, 1764, 1766, 1768-1772, 1775-1777, 1780-1781, 1783-1784, 1787-1800, 1802-1804, 1806-1809, 1811, 1814-1818, 1820, 1822-1823, 1826, 1832-1838, 1840-1851, 1855, 1859, 1865, 1867-1868, 1870, 1874, 1876-1877, 1879-1882, 1884-1886, 1888-1889, 1892-1894, 1897-1901, 1907, 1909-1910, 1912, 1914, 1916-1924, 1927-1928, 1930-1932, 1935-1938, 1941-1943, 1946, 1948-1949, 1951, 1954, 1957, 1960, 1962-1967, 1969-1973, 1977-1979, 1981-1983, 1985-1986, 1989-1991, 1995, 1999-2000, 2003, 2005-2010, 2014-2015, 2020, 2022-2025, 2027-2028, 2030-2032, 2034, 2036, 2040, 2042, 2045-2046, 2048-2058, 2060, 2062, 2064-2065, 2067, 2070, 2072, 2075-2077, 2079-2080, 2084, 2087-2088, 2092-2102, 2105-2106, 2113, 2120-2125, 2130, 2132-2133, 2136, 2138-2139, 2141-2142, 2145-2148, 2151-2154, 2156-2157, 2159, 2163-2165, 2167-2169, 2173-2175, 2177, 2182, 2184-2187, 2189, 2192, 2195-2197, 2200-2204, 2206-2207, 2209-2210, 2212-2213, 2216, 2218-2220, 2222-2226, 2228, 2230-2231, 2233-2234, 2238-2241, 2245, 2247-2249, 2254, 2257-2259, 2262-2264, 2266, 2268-2272, 2274-2277, 2279-2280, 2286-2287, 2289, 2292-2293, 2295-2296, 2299-2302, 2304-2309, 2312-2315, 2317-2334, 2336-2345, 2347-2350, 2352-2355, 2358-2359, 2364-2366, 2369-2370, 2372-2373, 2375, 2380, 2382, 2384-2386, 2388-2390, 2393-2394, 2396, 2399, 2401-2404, 2406, 2411, 2413-2415, 2418-2420, 2422-2423, 2425, 2430, 2432-2438, 2440, 2442, 2445-2448, 2451, 2454, 2456-2457, 2461-2464, 2467-2468, 2473-2479, 2481-2482, 2484-2488, 2491-2492, 2494-2500, 2504-2505, 2507-2510, 2512, 2514-2516, 2518-2528, 2530-2532, 2534, 2538-2539, 2541, 2543-2544, 2546, 2550-2552, 2554, 2556, 2558, 2561, 2563-2572, 2574, 2577, 2579-2581, 2583-2587, 2590, 2592-2596, 2599-2605, 2607-2608, 2611-2613, 2615-2616, 2619-2622, 2624, 2629-2634, 2636, 2638, 2640-2644, 2646, 2649-2651, 2655, 2657-2658, 2660, 2662-2668, 2670, 2672-2679, 2681-2683, 2685-2690, 2692-2693, 2697-2699, 2701-2702, 2705, 2707, 2710-2714, 2717, 2719, 2721, 2723, 2725-2726, 2728, 2731, 2733-2734, 2736-2737, 2739-2740, 2742-2743, 2745-2748, 2752-2754, 2756-2758, 2761, 2763, 2765-2766, 2768, 2770-2778, 2780, 2783-2784, 2789-2798, 2800, 2805-2806, 2808-2810, 2812, 2814, 2817-2828, 2830-2838, 2840-2841, 2843, 2845-2850, 2852-2853, 2856, 2858-2859, 2861-2862, 2864-2867, 2870, 2872-2874, 2876-2881, 2883-2885, 2887, 2889, 2892-2896, 2898, 2900-2902, 2905-2906, 2908, 2910-2912, 2915-2921, 2923, 2926-2928, 2932-2933, 2937-2938, 2940-2943, 2945-2946, 2948-2949, 2951-2958, 2962, 2970-2972, 2974, 2976-2977, 2979-2981, 2983, 2985-2988, 2990-2991, 2993, 2997, 2999-3000, 3003-3007, 3009-3012, 3016, 3018, 3021-3022, 3024-3025, 3027-3029, 3032-3033, 3035, 3037-3038, 3040-3042, 3046, 3048, 3050-3054, 3060-3062, 3071, 3074-3075, 3079-3081, 3083, 3085-3086, 3088, 3093, 3099, 3101-3102, 3105-3106, 3111-3114, 3116-3118, 3121-3125, 3127-3128, 3131, 3134, 3137-3138, 3141-3143, 3150-3151, 3153-3156, 3159-3160, 3162-3164, 3166-3173, 3175-3176, 3179-3184, 3187, 3190, 3192-3193, 3195-3201, 3205-3217, 3220-3221, 3223, 3225-3226, 3228-3229, 3231-3232, 3236-3250, 3252-3253, 3258-3259, 3261-3263, 3265-3271, 3273, 3275, 3281-3282, 3285, 3288, 3290-3296, 3298, 3301, 3304-3305, 3308-3310, 3312, 3314, 3319, 3322-3323, 3325-3327, 3329, 3331, 3333, 3335-3337, 3339-3344, 3346-3352, 3356-3358, 3360, 3364, 3366-3369, 3371-3381, 3384-3385, 3389-3391, 3393-3401, 3404-3406, 3408-3410, 3413-3415, 3421-3423, 3426-3428, 3431, 3433, 3437-3440, 3443-3448, 3450-3453, 3459-3461, 3463, 3466-3471, 3473-3475, 3477-3478, 3480, 3484-3488, 3490-3491, 3494-3496, 3498, 3500-3502, 3504, 3506, 3509-3511, 3513, 3515-3521, 3524-3531, 3533-3536, 3538-3540, 3542, 3545, 3547-3548, 3551-3555, 3558-3561, 3563-3565, 3567-3571, 3574, 3577, 3584-3585, 3587-3588, 3590, 3592, 3595-3600, 3602, 3604-3605, 3607, 3609, 3611-3616, 3618-3620, 3623-3624, 3627-3629, 3631-3637, 3642-3647, 3650-3655, 3657, 3660-3662, 3666-3668, 3670-3671, 3673-3676, 3679-3684, 3687-3688, 3691-3693, 3695-3700, 3703, 3705-3708, 3710, 3712, 3714-3716, 3719, 3722-3725, 3727-3729, 3731-3737, 3741, 3743-3745, 3748-3753, 3758-3760, 3763-3775, 3777, 3779-3785, 3787-3788, 3820-3821, 3825, 3850-3854, 3856-3859, 3861-3867, 3870-3874, 3876-3879, 3881, 3884-3885, 3887-3888, 3890, 3892-3895, 3897-3898, 3900-3901, 3904, 3906-3907, 3909-3916

Single Strand Oligonucleotides (Antisense Strand of Target Gene)
SeqID range: 3797-3819, 3822-3824, 3827-3849
SeqIDs w/o G Runs:
3797-3819, 3822-3824, 3827-3849
SeqIDs w/o miR Seeds:
3797-3798, 3800-3804, 3806-3808, 3811-3817, 3822-3824, 3827, 3829-3834, 3836-3838, 3843, 3845-3847

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

SEQUENCE LISTING (3917 sequences)

SEQ ID NO: 1 - DNA, 25606 bp, Homo sapiens
gttaattatccttgtattggaagagctaaaatatcaaataaaggacagtgcagaaatctagatgttagtaacatcagaaaacctcttccgccattaggcctagaagggcagaaggagaaaatgtttataccaccagagtccagaaccagagcccataaccagaggtccactggattcagtgagctagtgggtgctccttggagagagccagaactgtctaatgggggcatcaaagtatcagccataaaaaaccataaaaaagactgtctgctgtaggagatccgttcagagagagagagagaccagaaataatcttgcttatgctttccctcagccagtgtttaccattgcagaatgtacatgcgactgaaagggtgaggaaacctgggaaatgtcagttcctcaaatacagagaacactgagggaaggatgagaaataaatgtgaaagcagacatgaatggtaattgacagaaggaaactaggatgtgtccagtaaatgaataattacagtgtgcagtgattattgcaatgattaatgtattgataagataatatgaaaacacagaattcaaacagcagtgaactgagattagaattgtggagagcactggcatttaagaatgtcacacttagaatgtgtctctaggcattgttctgtgcatatatcatctcaatattcattatctgaaaattatgaattaggtacaaagctcaaataatttattttttcaggttagcaagaactttttttttttttttctgagatagagcattgctatggttgcccaggctggagtgcaatggcatgatccaggctcactgcaacatctgcctcccaggttcaagcgattctcctgcctcagcctcccaagtagctggcactacaggcatgtgccaccaccatgcctggctaattttctatttttagtagatagggggtttcaccatgttggtcaggctgatctcgaactcctaacatcaggtgatccaccctcctcggcctctgaaagtgctgggatcacaggcgtgagccaccacacccagccaagaatgtgaattttgtagaaggatataacccatatttctctgaccctagagtccttagtatacctcccataccatgtggctcatcctccttacatacatttcccatctttcaccctaccttttcctttttgtttcagcttttcactgtgtcaaaatctagaaccttatctcctacctgctctgaaaccaacagcaagttgacttccattctaacccacattggcattacactaattaaaatcgatactgagttctaaaatcatcggggattttggggactatgtcttacttcatacttccttgagatttcacattaaatgttggtgttcattaaaggtccttcatttaactttgtattcatcacactcttggattcacagttatatctaaactcttaaatacagcctgtataatcccaattcccaactctgatttctaacctctgacctccaacctcagtgccaaacccatatatcaaacaatgtactgggcttatttatatagatgtcctataggcacctcagactcagcatgggtatttcacttgttatactaaaactgtttctcttccagtgttttccattttagtcattagatagctacttgcccattcaccaaggtcacagattaaaatcatttccctacctctaatcaacagttcgattctgcttcaatttgtccctatctattaatcaccactcttactgcccagtcaggtcctcattgtttcctgaacaagagtagatgctattctttccacttttagaccttatcctggctggatgcggtggctcaggcttgtaaacccagcactttgggaggccaaggcaggcagatcacttgaggtcaggagttcaagaccagcctgaccaacatggtgaaaccccatctctactaaaaatacaaaatcagccgggcgtgtggtgcatgcctgcagtcccagctattcaggtggctgaggcaggagaattgcttgaacccaggaggcagaggttgcggtgagcctagattgcaccattgcactctagcttgggcaatagggatgaaactccatctcagaagagaaaagaaaaaaagaccttattctgttatacaaatcctctcaatgcaatccatatagaataaacatgtaaccagatctcccaatgtgtaaaatcatttcaggtagaacagaattaaagtgaaaagccaagtctttggaattaacagacaaagatcaaataacagtcctcatggccttaagaatttacctaacattttttttagaatcaattttcttatatatgaattggaaacataattcctccctcacaaacacattctaagattttaaggagatattgatgaagtacatcatctgtcatttttaacaggtagtggtagtgattcacacagcacattatgatctgttcttgtatgttctgttccattctgtattcttgacctggttgtattctttctgagctccagatccacatatctaagtacatctttttgcattttacaagagtgcatacaatacaatgtatccaagactgtatttctgattttatcgtaccactaaactcacaaatgtggccctattcttgtgttcacgactgacatcaccgtcatggtccaagtctgataatagaaatggcattgtcactttcttccctactgcaacagaagcccagctatttgtctcccattttctctacttctaaaatacatttcttcactaagtgagaataatcttttaaagacacaaatcaaaccatgccaccacctttcttgaattattcaatatctttcgttggcttccaggttacagaaaaataacttgtaacaaagtttaaaggtcattcatggctcctctctaccctattttataacatttccccttgtgatcagaatctcaggcacatcatccatctttctatatacaaataaagtcatatagtttgaactcacctctggttacttttaatcaaccaaatgctgtaaaatgcatttgtatcgctacgtgttaagcagtagttgattcttttcatttctgtgtaatattctattctttgactataccgtaatttatcaattctactgttggtaagcatttaagtggctaccggtttgaggtttttatgattattgctgtcataagcatttctatacatgtctttggatacacacatgcatgtgtttctgaatatctaaaaatgtaattgctaggtaatagacttatcaagcatccagcatttgtggatactattaaaggttttccaaaggggttatactattgtacagtgtcaccaacagagtttgagtttctattgatccatatcaccaccaaaatttgaactgtcagtcttatctcttctcttgtctcttttttcctcttttttttccttcccttcccctctcttcgtttcttttctctcctcttctcttctttcctctcttcccttccctttctctttctcttccctatcccttctcctctcctctcccctccttttttctcctctcctctccattatttatttttccttcttctcctccatcccttccatcctctctcttcccctcttccttccttcctttctccatttcttcctcctctttccttcaatccttccttttggatatgctcatgggtgtgtatttgtctgccattgtggcattatttgaattcagaaaagagtgaaaaactactgggatcttcattcctgggtctaattccacatttttttttaagaacacatctgtaaaaatgttctgtactagcatattcccaggaacttcgttaaatttaatctggctgaatatggtaaatctacttttcactttgcattctttctttagtcataccataattttaaacattcaaaatatttgtatataatatttgattttatctgtcattaaaatgttaaccttaaaattcatgtttccagaacctatttcaataactggtaaataaacactattcattttttaaatattcttttaatggatatttatttcaatataataaaaaattagagttttattataggaagaatttaccaaaagaaggaggaagcaagcaagtttaaactgcagcaatagatttgtccattccaacctctcaaaattcccttggagacaaaaatctctagaggcaaagaagaactttatattgagtcaacttgttaaaacatctgcttttagataagttttcttagtataaagtgacagaaacaaataagttaaactctaagatacattccactatattagcctaaaacacttctgcaaaaatgaaactaggaggatatttttagaaacaactgctgaaagagatgcggtggggagatatgtagaggagaacagggtttctgagtcaagacacacatgacagaacagccaatctcagggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcaggttggtatcaaggttataagagaggctcaaggaggcaaatggaaactgggcatgtgtagacagagaagactcttgggtttctgataggcactgactctctgtcccttgggctgttttcctaccctcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgagtccaggagatgcttcacttttctctttttactttctaatcttacattttggttcttttacctacctgctcttctcccacatttttgtcattttactatattttatcatttaatgcttctaaaattttgttaattttttatttaaatattctgcattttttccttcctcacaatcttgctattttaaattatttaatatcctgtctttctctcccaaccccctcccttcatttttccttctctaacaacaactcaaattatgcataccagctctcacctgctaattctgcacttagaataatccttttgtctctccacatgggtatgggagaggctccaactcaaagatgagaggcatagaatactgttttagaggctataaatcattttacaataaggaataattggaattttataaattctgtagtaaatggaatggaaaggaaagtgaatatttgattatgaaagactaggcagttacactggaggtggggcagaagtcgttgctaggagacagcccatcatcacactgattaatcaattaatttgtatctattaatctgtttatagtaattaatttgtatatgctatatacacatacaaaattaaaactaatttggaattaatttgtatatagtattatacagcatatatagcatatatgtacatatatagactacatgctagttaagtacatagaggatgtgtgtgtatagatatatgttatatgtatgcattcatatatgtacttatttatgctgatgggaataacctggggatcagttttgtctaagatttgggcagaaaaaaatgggtgttggctcagtttctcagaagccagtctttatttctctgttaaccatatgcatgtatctgcctacctcttctccgcagctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttcctgattaatttcacttatttcatttttttgtccaggtgtgtaagaaggttcctgaggctctacagatagggagcacttgtttattttacaaagagtacatgggaaaagagaaaagcaagggaaccgtacaaggcattaatgggtgacacttctacctccaaagagcagaaattatcaagaactcttgatacaaagataatactggcactgcagaggttctagggaagacctcaaccctaagacatagcctcaagggtaatgctacgattaaactccaacaattactgagaaaataatgtgctcaattaaaggcataatgattactcaagacaatgttatgttgtctttcttcctccttcctttgcctgcacattgtagcccataatactataccccatcaagtgttcctgctccaagaaatagcttcctcctcttacttgccccagaacatctctgtaaagaatttcctcttatcttcccatatttcagtcaagattcattgctcacgtattacttgtgacctctcttgaccccagccacaataaacttctctatactacccaaaaaatctttccaaaccctcccccacaccattttttatatttttatatttttcttatttatttcatgcacacacacacactccgtgctttataagcaattctgcctattctctaccttcttacatgcctactgtgcctcatattaaattcatcaatgggcagaaagaaaatatttattcaagaaaacagtgaatgaatgaacgaatgagtaaatgagtaaatgaaggaatgattattccttgctttagaacttctggaattagaggacaatattaataataccatcgcacagtgtttctttgttgttaatgctacaacatacaaagaggaagcatgcagtaaacaaccgaacagttatttcctttctgatcataggagtaatatttttttccttgagcaccatttttgccataggtaaaattagaaggatttttagaactttctcagttgtatacatttttaaaaatctgtattatatgcatgttgattaattttaaacttacttgaatacctaaacagaatctgttgtttccttgtgtttgaaagtgctttcacagtaactctgtctgtactgccagaatatactgacaatgtgttatagttaactgttttgatcacaacattttgaattgactggcagcagaagctcttttatatccatgtgttttccttaagtcattatacatagtaggcactgagaactctttatatctgaataagatatttaggaaccactggtttacatatcagaagcagagctactcagggcattttggggaagatcactttcacattcctgagcatagggaagttctcataagagtaagatattaaaaggagatacttgtgtggtattcgaaagacagtaagagagattgtagaccttatgatcttgatagggaaaacaaactacattcctttctccaaaagtcaaaaaaaaagagcaaatatagcttactataccttctattcctacaccattagaagtagtcagtgagtctaggcaagatgttggccctaaaaatccaaataccagagaattcatgagaacatcacctggatgggacatgtgccgagcacacacaattactatatgctaggcattgctatcttcatattgaagatgaggaggtcaagagatgaaaaaagacttggcaccttgttgttatattaaaattatttgttagagtagagcttttgtaagagtctaggagtgtgggagctaaatgatgatacacatggacacaaaaaatagatcaacagacacccaggcctacttgagggttgagggtgggaagagggagacgatgaaaaagaacctattgggtattaagttcatcactgagtgatgaaataatctgtacatcaagacccagtgatatgcaatttacctatataacttgtacatgtacccccaaatttaaaatgaaagttaaaacaaagtataggaatggaattaattcctcaagatttggctttaattttatttgataatttatcaaatggttgtttttcttttctcactatggcgttgctttataaactatgttcagtatgtctgaatgaaagggtgtgtgtgtgtgtgaaagagagggagagaggaagggaagagaggacgtaataatgtgaatttgagttcatgaaaatttttcaataaaataatttaatgtcaggagaattaagcctaatagtctcctaaatcatccatctcttgagcttcagagcagtcctctgaattaatgcctacatgtttgtaaagggtgttcagactgaagccaagattctacctctaaagagatgcaatctcaaatttatctgaagactgtacctctgctctccataaattgacaccatggcccacttaatgaggttaaaaaaaagctaattctgaatgaaaatctgagcccagtggaggaaatattaatgaacaaggtgcagactgaaatataaatttttctgtaataattatgcatatactttagcaaagttctgtctatgttgactttattgctttttggtaagaaatacaactttttaaagtgaactaaactatcctatttccaaactattttgtgtgtgtgcggtttgtttctatgggttctggttttcttggagcatttttatttcattttaattaattaattctgagagctgctgagttgtgtttactgagagattgtgtatctgcgagagaagtctgtagcaagtagctagactgtgcttgacctaggaacatatacagtagattgctaaaatgtctcacttggggaattttagactaaacagtagagcatgtataaaaatactctagtcaagtgctgcttttgaaacaaatgataaaaccacactcccatagatgagtgtcatgattttcatggaggaagttaatattcatcctctaagtatacccagactagggccattctgatataaaacattaggacttaagaaagattaatagactggagtaaaggaaatggacctctgtctctctcgctgtctcttttttgaggacttgtgtgtgtgtgtgtgtgtgtgtgtgtgtgtgtgttgtggtcagtggggctggaataaaagtagaatagacctgcacctgctgtggcatccattcacagagtagaagcaagctcacaatagtgaagatgtcagtaagcttgaatagtttttcaggaactttgaatgctgatttagatttgaaactgaggctctgaccataaccaaatttgcactatttattgcttcttgaaacttatttgcctggtatgcctgggcttttgatggtcttagtatagcttgcagccttgtccctgcagggtattatgggtaatagaaagaaaagtctgcgttacactctagtcacactaagtaactaccattggaaaagcaacccctgccttgaagccaggatgatggtatctgcagcagttgccaacacaagagaaggatccatagttcatcatttaaaaaagaaaacaaaatagaaaaaggaaaactatttctgagcataagaagttgtagggtaagtctttaagaaggtgacaatttctgccaatcaggatttcaaagctcttgctttgacaattttggtctttcagaatactataaatataacctatattataatttcataaagtctgtgcattttctttgacccaggatatttgcaaaagacatattcaaacttccgcagaacactttatttcacatatacatgcctcttatatcagggatgtgaaacagggtcttgaaaactgtctaaatctaaaacaatgctaatgcaggtttaaatttaataaaataaaatccaaaatctaacagccaagtcaaatctgcatgttttaacatttaaaatattttaaagacgtcttttcccaggattcaacatgtgaaatcttttctcagggatacacgtgtgcctagatcctcattgctttagttttttacagaggaatgaatataaaaagaaaatacttaaattttatccctcttacctctataatcatacataggcataattttttaacctaggctccagatagccatagaagaaccaaacactttctgcgtgtgtgagaataatcagagtgagattttttcacaagtacctgatgagggttgagacaggtagaaaaagtgagagatctctatttatttagcaataatagagaaagcatttaagagaataaagcaatggaaataagaaatttgtaaatttccttctgataactagaaatagaggatccagtttcttttggttaacctaaattttatttcattttattgttttattttattttattttattttattttgtgtaatcgtagtttcagagtgttagagctgaaaggaagaagtaggagaaacatgcaaagtaaaagtataacactttccttactaaaccgacatgggtttccaggtaggggcaggattcaggatgactgacagggcccttagggaacactgagaccctacgctgacctcataaatgcttgctacctttgctgttttaattacatcttttaatagcaggaagcagaactctgcacttcaaaagtttttcctcacctgaggagttaatttagtacaaggggaaaaagtacagggggatgggagaaaggcgatcacgttgggaagctatagagaaagaagagtaaattttagtaaaggaggtttaaacaaacaaaatataaagagaaataggaacttgaatcaaggaaatgattttaaaacgcagtattcttagtggactagaggaaaaaaataatctgagccaagtagaagaccttttcccctcctacccctactttctaagtcacagaggctttttgttcccccagacactcttgcagattagtccaggcagaaacagttagatgtccccagttaacctcctatttgacaccactgattaccccattgatagtcacactttgggttgtaagtgactttttatttatttgtatttttgactgcattaagaggtctctagttttttatctcttgtttcccaaaacctaataagtaactaatgcacagagcacattgatttgtatttattctatttttagacataatttattagcatgcatgagcaaattaagaaaaacaacaacaaatgaatgcatatatatgtatatgtatgtgtgtatatatacacacatatatatatatattttttcttttcttaccagaaggttttaatccaaataaggagaagatatgcttagaaccgaggtagagttttcatccattctgtcctgtaagtattttgcatattctggagacgcaggaagagatccatctacatatcccaaagctgaattatggtagacaaaactcttccacttttagtgcatcaacttcttatttgtgtaataagaaaattgggaaaacgatcttcaatatgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaataaatttgaatgggttaaagaattaaactaagacctaaaaccataaaaatttttaaagaaatcaaaagaagaaaattctaatattcacgttgcagccgttttttgaatttgatatgagaagcaaaggcaacaaaaggaaaaataaagaagtgaggctacatcaaactaaaaaatttccacacaaaaaacaaaacaatgaacaaatgaaaggtgaaccatgaaatggcatatttgcaaaccaaatatttcttaaatattttggttaatatccaaaatatataagaaacacagatgattcaataacaaacaaaaaattaaaaataggaaaataaaaaaattaaaaagaagaaaatcctgccatttatggcagaattgatgaacctggaggatgtaaaactaagaaaaataagcctgacacaaaaagacaaatactacacaaccttgctcatatgtgaaacataaaaaagtcactctcatggaaacagacagtagaggtatggtttccaggggttgggggtgggagaatcaggaaactattactcaaagggtataaaatttcagttatgtgggatgaataaattctagatatctaatgtacagcatcgtgactgtagttaattgtactgtaagtatatttaaaatttgcaaagagagtagatttttttttttttttagatggagttttgctcttgttgtccaggctggagtgcaatggcaagatcttggctcactgcaacctccgcctcctgggttcaagcaaatctcctgcctcagcctcccgagtagctgggattacaggcatgcgacaccatgcccagctaattttgtatttttagtagagacggggtttctccatgttggtcaggctgatccgcctgcctcggccacccaaagggctgggattacaggcgtgagccaccgggcctggccgagagtagatcttaaaagcatttaccacaagaaaaaggtaactatgtgagataatgggtatgttaattagcttgattgtggtaatcatttcacaaggtatacatatattaaaacatcatgttgtacaccttaaatatatacaatttttatttgtgaatgatacctcaataaagttgaagaataataaaaaagaatagacatcacatgaattaaaaaactaaaaaataaaaaaatgcatcttgatgattagaattgcattcttgatttttcagatacaaatatccatttgactgtttactcttttccaaaacaatacaataaattttagcactttatcttcattttccccttcccaatctataattatatatatatatattttagatattttgtatagttttactccctagattttctagtgttattattaaatagtgaagaaatgtttacacttatgtacaaaatgttttgcatgcttttcttcatttctaacattctctctaagtttattctatttttttctgattatccttaatattatctctttctgctggaaatacattgttacttttggtttatctaaaaatggcttcattttcttcattctaaaatcatgttaaattaataccactcatgtgtaagtaagatagtggaataaatagaaatccaaaaactaaatctcactaaaatataataatgtgatatataaaaatatagcttttaaatttagcttggaaataaaaaacaaacagtaattgaacaactatactttttgaaaagagtaaagtgaaatgcttaactgcatataccacaatcgattacacaattaggtgtgaaggtaaaattcagtcacgaaaaaactagaataaaaatatgggaagacatgtatataatcttagagataacactgttatttaattatcaacccaaagtagaaactatcaagggagaaataaattcagtcaacaataaaagcatttaagaagttattctaggctgggagcggtggctcacacctgcaattgcagcactttgggaggcctagacaggcggatcacgacgtcaggagttcaagatcagcctggccaacatagtgaaacctcatcgctactaaaaatataaaaacttagcctggcgtggtggcaggcatgtgtaatcccagcaatttgggaggctgaggcaggagaatcgcttgatcctgggaggcagaggttgcagtgagccaagattgtgccactgcattccagcccaggtgacagcatgagactccgtcacaaaaaaaaaagaaaaaaaaaaggggggggggagcggtggagccaagatgaccgaataggaacagctccagtctatagctcccatcgtgagtgacgcagaagacgggtgatttctgcatttccaactgaggtaccaggttcatctcacagggaagtgccaggcagtgggtgcaggacagtaggtgcagtgcactgtgcatgagccaaagcagggcgaggcatcacctcacccgggaagcacaaggggtcagggaattccctttcctagtcaaagaaaagggtgacagatggcacctggaaaatcgggtcactcccgccctaatactgcgctcttccaacaagcttaacaaatggcacaccaggagattatatcccatgcctggctcagagggtcctacgcccatggagcctcgctcattgctagcacagcagtctgaggtcaaactgcaaggtggcagtgaggctgggggaggggtgcccaccattgtccaggcttgagcaggtaaacaaagccgcctggaagctcgaactgggtggagcccaccacagctcaaggaggcctgcctgcctctgtaggctccacctctaggggcagggcacagacaaacaaaagacaacaagaacctctgcagacttaaatgtccctgtctgacagctttgaagagagtagtggttctcccagcacatagcttcagatctgagaacaggcagactgcctcctcaagtgggtccctgacccccgagtagcctaactgggaggcatcccccagtaggggcagactgacacctcacatggctggtactcctctaagacaaaacttccagaggaatgatcaggcagcagcatttgcggttcaccaatatccactgttctgcagccaccgctgttgatacccaggaaaacagcttctggagtggacctccagtaaactccaacagacctgcagctgagggtcctgactgttagaaggaaaactaacaaacagaaaggacatccacaccaaaaacccatctgtacatcgccatcatcaaagaccaaaggtagataaaaccataaagatggggaaaaagcagagcagaaaaactggacactctaaaaatgagagtgcctctcctcctccaaagtaacgcagctcctcaccagcaatggaacaaagctgggcagagaatgactttgacgagttgagagaggaaggcttcagaagatcaaactactccaagctaaaggaggaagttcgaacaaacggcaaagaagtaaaaaactttgaaaaaaaattagatgaatggataactagaataaccaatgcacagaagtccttaaaggacctgatggagctgaaaaccaaggcaggagaactacgtgacaaatacacaagcctcagtaaccgatgagatcaactggaagaaagggtatcaatgacgaaagatgaaatgaatgaaatgaagcatgaagagaagtttagagaaaaaagaataaaaagaaacgaacaaagcctccaagaaatatgggactatgtgaaaagaccaaatctacatctaattggtgtagctgaaagtgatggggagaatggaaccaagttggaaaacactctgcaggatattatccaggagaacttccccaatctagcaaggcaagcccaaattcacattcaggaaatacagagaacgccacaaagatactcctagagaaaagcaactccaagacacataactgtcagattcaccaaagttgaaatgaaggaaaaaatgttaagggcagccagagagaaaggtcgggttacccacaaagggaagcccatcagactaacagctgatctatcggcagaaactctacaagccagaagaaagtgggggccaatattcaacattgttaaagaaaagaattttcaacccagaatttcatatccagccaaactaagcttcataagtgaaggagaaataaaatcctttacagacaagcaaatgctgagagattttgtcaccaccaggcctgccctacaagagctcctgaaggaagcactaaacatggaaaggaacaactagtatcagccactgcaaaaacatgccaaattgtaaagaccatcaaggctaggaagaaactgcatcaacgagcaaaataaccagctaacatcataatgacaggatcaaattcatacataacaatactcaccttaaatgtaaataggctaaatgctccaattaaaagacacagactggcaaattggataaggagtcaagacccatctgtgttctgtattcaggaaacccatctcacgtgcagagacacacataggctcgaaataaaaggatggaggaatatctaccaagcaaatggaaaacaaaaaaaggcaggggttgcaatcctagtctctgataaaacagattttaaaccaacaaagatcaaaagagacaaagaaggccattacataatggcaaagggatctattcaagaagaagaactaactatactaaatatatatgcacccaatacaggagcacccagattcataaaacaagtcctgagtgacctacaaagagacttagatgcccacacaataataatgggagactttaacaccccactgtcaacattagacagatcaacgagacagaaagttaacaaggatatccaggaattggactcagctctgcaccaagcagacctaatagacatctacagaactctccaccccaaatcaacagaatatacattcttttcagcaccacaccacacctattccaaaactgaccacatagttggaagtaaagctctcctcagcaaatgtaaaagaacagaaactataacaaactgtctctcagaccacagtgcaatcaaactagaactcaggattaagaaactcactcaaaaccactcagctacatggaaactgaacagcctgctcctgaatgactactgggtacataacaaaatgaaggcagaaataaagatgttctttgaaaccaacgagaacaaagacacaacacaccagaatctctgagacacattcaaagcagtgtgtagagggaaatttatagcactaaatgcccacaagggaaagcaggaaagatctaaaattgacaccctaacatcacaattaaaaaactagagaagcaggagcaaacacattcaaaagctaacagaagacaagaaataactaagatcagagcagaagtgaaggacatagagacacaaaaaaacccttcaaaaaaatcaatgaatccagaagctgtttttttgaaaagatcaacaaaattgatagactgctagcaagactaataaagaagaaaagagagaagaatcaaatagacgcaataaaaaatgacacggggtatcaccactgatcccacagaaatacaaactaccgtcagagaatactataaacacctctacgcaaataaactagaaaatctagaagaaatggataaattcctcgacacatacactctgccaagactaaaccaggaagaagttgtatctctgaatagaccaataacaggctctgaaattgaggcaataattaatagcttatcaaccaaaaaaagtccgggaccagtaggattcatagccgaattctaccagaggtacaaggaggagctggtaccattccttctgaaactattccaatcaatagaaaaagagggaatcctccctaactcattttatgaggccagcatcatcctgataccaaagcctgacagagacacaacaaaaaaagagaatgttacaccaatatccttgatgaacattgatgcaaaaatcctcaataaaatactggcaaactgatccaccatgatcaagtgggcttcatccctgccatgcaaggctggttcaacatacgaaaatcaataaacataatccagcatataaacagaaccaaagacacaaaccatatgattatctcaatagatgcagaaaaggcctttgacaaaattcaacaacgcttcatgctaaaaactctcaataaattaggtattgatgggacatatctcaaaataataagagctatctatgacaaacccacagccaatatcatactgagtggacaaaaactggaagcattccctttgaaaactggcacaaggcagggatgccctctctcaccactcctattcaacatagtgttgtaagttctggccagggcaatcaggcaggagaaggaaataaagggcattcaattaggaaaagaggaagtgaaattgtccctgtttgcagatgacatgattgtatatctagaaaaccccattgtctcagcccaaaatctccttaagctgataagcaacttcagcaaagtctcaggatataaaatcagtgtgcaaaaatcacaagtattcctatgcaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggtcatactgcccaaggtaatttatagattcaatgccatccccatcaagctaccaatgactttcttcacagaactggaaaaaactactttaaagttcatatggaaccaaaaaagagcccacatcaccaaggcaatcctaagccaaaagaacaaagctggaggcatcacgctacctgacttcaaactatactacaatgctacggtaaccaaaacagcatggtactggtaccaaaacagagatctagaccaatggaacagaacagagccctcagaaataatgccgcatatctacaactatctgatctttgacaaacctgagagaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaaaaaaacctaggcaataccattcaggacataggcatgggcaaggacttcatgtctaaaacaccaaaagcaatggcaacaaaagacaaaatggacaaacgggatctaattaaactaaagagcttctgcacagctaaagaaactaccatcagagtgaacaggcaacctacaaaatgggagaaaatttttgcaatctactcatctgacaaagggctaatatccagaatctacaatgaactcaaacaaatttacaagaaaaaacaaacaaccccatcaaaaagtgggcaaaggatatgaacagacacttcgcaaaagaagacatttatgtaatcaaaaaacacatgaaaaaatgctcatcatcactagccatcagagaaatgcaaatcaaaaccacaatgagataccatctcacaccagttagaatggcgatcattaaaaagtcaggaaacaacaggtgctggagaggatgtggagaaacaggaacaacttttacactgttggtgggactgtaaactagttcaaccattgcggaagtcagtgtggcaattcctcaggaatctagaactagaaataccatttgacccagccatcccattactgggtacatacccaaaggattataaatcatgctgctataaagacacatgcacacgtatgtttattgcagcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaactatcattctcagcaaactatcacaaggagaataaaccaaacaccgcatgttctcactcataggtgggaattgaacaatgagaacacatggacacatgaagaggaacatcacactctggggactgttatggggtggggggcaggggcagggatagcactaggagatatacctaatgctaaatgacgagttaatgggtgcagcacaccaacatggcacatgtatacatatataacaaacctgcatgttgtgcacatgtaccctaaaacttgaagtataataataaaaaaaagttatcctattaaaactgatctcacacatccgtagagccattatcaagtctttctctttgaaatagacagaaatttagtgttttctcagtcagttaacattccttcaactagattagttgtgacaaaatttcaggccttgctcaactctaacctcagtctctccatatatttctgagagtcttccttcttatttgtttataagaatttagtaaatggcaatattgagaagtagaaaattttggagacttgtttttcatgaaccagaacaatctcaaagcagcaatactaaacaggagccaagcctagaataaagttgaatttctggaatcaacaagctaggggaaagtctcccattaagtcaaatatttgacaactgggaggtcaagtcagaggtgaaaaatgattaaagataacaagaggtctgaaaacaaagtgaccaattaaaataaaaagaaagagccaagctgggcacagtggcttgcatctgtagtcccagtaacccaggaggctgaagtgataggatcacttgagcccaggatttcagggttgcagtgagcaataatgacaccactgctctctagccttggtgactgagatcctgtctctgaggaaaaacaaacaaacaagcaaaaaacaaacaaacaaacacacagatattaagaacatagaagttttgttacggtgatgatattctccaacacaggtctgaaccccttgcagtgcctcggggctgtttctccagtggattcttgggttcttcacatcttctcaactttgtgaaaagatattcatccaaaggtctcacctgtcttattcagagcttggattttggactagctttttctatttcttgggattctctagagccatatattcagatataacacagatataaccaaaagaagcaaaggaggcatcacagaaggggctttgtattctggggagggggacatagagttgagagaaatacaggaatttataggactctactcaaagagccctcaaataaagtacggctagtcttctttgcctaagacaatgagcagtccaggaagttatccatttcttttagattttctagtttatgtacatagagatgttcatagtagtttttgatgattatttgtatttctgtggggtgagtgataatattccctttttcatttctaactgtgcttatttggatcttctctcttgtcttctttattagtctagctagtgatctaccttattaattttttcacaaaaccagctcttggactcattaatcttttgaatggtattttgtgttttaatatccttcagttagctttgatcttgtttatttcttgtcttctgctagatttagggttggtttgctcttggttctctggttcttttagttgtgacattaggttgttaatttgagggctttaagactttttgatgtgggcatttagtgtataaatttctctcttaacactgtctaagctgtgtcccagagattccggtatattgtatctttgttctcattagtttcaaagaactattttatttttgccttagttttcattatttacccaaaattcattcaggagcaggttgtttaatttccatgtaattgcatagttttcagctattcattagtcttgaaatctatttttattcctctgtggtctgagagtgattgatatgattttttttttgcatttgctgaggattgttttaggtcctcccaaggctgaaccaggaagaaatcaatttcctgaagagatccatgatgagctctgaaaatgattcagtaataaatagcctatcaaacaaaaaaagccctggacaatatgattcacaaccaaattctatcagatgcacaaagaagagttggaaaaattcctactgaagctactccaaaaaattgagggggagggattcaacctcagctcattttatgaggccagcatcatcctgataccaaaacctgatagacacacaacaacaaaaaaagaaaacttcaggccaatatccttgaacattgatgcaaaaatactagcaagccaaatccagcaacacatcacaaagctaatccacctcaatcaagtaggctttatccctgagaagcaagattggttcagcatatacaaattgataaatgtgattcatcatatatacagcactaaaaacagaaaccacatgatcatttcaatatgtgcaaaaaaagattttgataaaattcaacttcacttcatgttaaaacctctcaacaaactagctatttaaggacatgacctcaaaataatatgagccatctatgacaaacccacagccaacatcatacagaatgggcaaaacctggaagcattcttcttgaaaactggcacaagacaaggatgccctctctcaccactgctattcagtatagtactggcagtcctggccagagcaatcaggcaagagaagggaataaagggcatccaaataggaagagagaaagtcaaagtatccctgttttctgtatctagaaaacaccatagtcaaggcccaaaagctccttcagctgataac

SEQ ID NO: 2 - DNA, 25606 bp, Homo sapiens
gttatcagctgaaggagcttttgggccttgactatggtgttttctagatacagaaaacagggatactttgactttctctcttcctatttggatgccctttattcccttctcttgcctgattgctctggccaggactgccagtactatactgaatagcagtggtgagagagggcatccttgtcttgtgccagttttcaagaagaatgcttccaggttttgcccattctgtatgatgttggctgtgggtttgtcatagatggctcatattattttgaggtcatgtccttaaatagctagtttgttgagaggttttaacatgaagtgaagttgaattttatcaaaatctttttttgcacatattgaaatgatcatgtggtttctgtttttagtgctgtatatatgatgaatcacatttatcaatttgtatatgctgaaccaatcttgcttctcagggataaagcctacttgattgaggtggattagctttgtgatgtgttgctggatttggcttgctagtatttttgcatcaatgttcaaggatattggcctgaagttttctttttttgttgttgtgtgtctatcaggttttggtatcaggatgatgctggcctcataaaatgagctgaggttgaatccctccccctcaattttttggagtagcttcagtaggaatttttccaactcttctttgtgcatctgatagaatttggttgtgaatcatattgtccagggctttttttgtttgataggctatttattactgaatcattttcagagctcatcatggatctcttcaggaaattgatttcttcctggttcagccttgggaggacctaaaacaatcctcagcaaatgcaaaaaaaaaatcatatcaatcactctcagaccacagaggaataaaaatagatttcaagactaatgaatagctgaaaactatgcaattacatggaaattaaacaacctgctcctgaatgaattttgggtaaataatgaaaactaaggcaaaaataaaatagttctttgaaactaatgagaacaaagatacaatataccggaatctctgggacacagcttagacagtgttaagagagaaatttatacactaaatgcccacatcaaaaagtcttaaagccctcaaattaacaacctaatgtcacaactaaaagaaccagagaaccaagagcaaaccaaccctaaatctagcagaagacaagaaataaacaagatcaaagctaactgaaggatattaaaacacaaaataccattcaaaagattaatgagtccaagagctggttttgtgaaaaaattaataaggtagatcactagctagactaataaagaagacaagagagaagatccaaataagcacagttagaaatgaaaaagggaatattatcactcaccccacagaaatacaaataatcatcaaaaactactatgaacatctctatgtacataaactagaaaatctaaaagaaatggataacttcctggactgctcattgtcttaggcaaagaagactagccgtactttatttgagggctctttgagtagagtcctataaattcctgtatttctctcaactctatgtccccctccccagaatacaaagccccttctgtgatgcctcctttgcttcttttggttatatctgtgttatatctgaatatatggctctagagaatcccaagaaatagaaaaagctagtccaaaatccaagctctgaataagacaggtgagacctttggatgaatatcttttcacaaagttgagaagatgtgaagaacccaagaatccactggagaaacagccccgaggcactgcaaggggttcagacctgtgttggagaatatcatcaccgtaacaaaacttctatgttcttaatatctgtgtgtttgtttgtttgttttttgcttgtttgtttgtttttcctcagagacaggatctcagtcaccaaggctagagagcagtggtgtcattattgctcactgcaaccctgaaatcctgggctcaagtgatcctatcacttcagcctcctgggttactgggactacagatgcaagccactgtgcccagcttggctctttctttttattttaattggtcactttgttttcagacctcttgttatctttaatcatttttcacctctgacttgacctcccagttgtcaaatatttgacttaatgggagactttcccctagcttgttgattccagaaattcaactttattctaggcttggctcctgtttagtattgctgctttgagattgttctggttcatgaaaaacaagtctccaaaattttctacttctcaatattgccatttactaaattcttataaacaaataagaaggaagactctcagaaatatatggagagactgaggttagagttgagcaaggcctgaaattttgtcacaactaatctagttgaaggaatgttaactgactgagaaaacactaaatttctgtctatttcaaagagaaagacttgataatggctctacggatgtgtgagatcagttttaataggataacttttttttattattatacttcaagttttagggtacatgtgcacaacatgcaggtttgttatatatgtatacatgtgccatgttggtgtgctgcacccattaactcgtcatttagcattaggtatatctcctagtgctatccctgcccctgccccccaccccataacagtccccagagtgtgatgttcctcttcatgtgtccatgtgttctcattgttcaattcccacctatgagtgagaacatgcggtgtttggtttattctccttgtgatagtttgctgagaatgatagtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatgtacccagtaatgggatggctgggtcaaatggtatttctagttctagattcctgaggaattgccacactgacttccgcaatggttgaactagtttacagtcccaccaacagtgtaaaagttgttcctgtttctccacatcctctccagcacctgttgtttcctgactttttaatgatcgccattctaactggtgtgagatggtatctcattgtggttttgatttgcatttctctgatggctagtgatgatgagcattttttcatgtgttttttgattacataaatgtcttcttttgcgaagtgtctgttcatatcctttgcccactttttgatggggttgtttgttttttcttgtaaatttgtttgagttcattgtagattctggatattagccctttgtcagatgagtagattgcaaaaattttctcccattttgtaggttgcctgttcactctgatggtagtttctttagctgtgcagaagctctttagtttaattagatcccgtttgtccattttgtcttttgttgccattgcttttggtgttttagacatgaagtccttgcccatgcctatgtcctgaatggtattgcctaggtttttttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttctctcaggtttgtcaaagatcagatagttgtagatatgcggcattatttctgagggctctgttctgttccattggtctagatctctgttttggtaccagtaccatgctgttttggttaccgtagcattgtagtatagtttgaagtcaggtagcgtgatgcctccagctttgttcttttggcttaggattgccttggtgatgtgggctcttttttggttccatatgaactttaaagtagttttttccagttctgtgaagaaagtcattggtagcttgatggggatggcattgaatctataaattaccttgggcagtatgaccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgcataggaatacttgtgatttttgcacactgattttatatcctgagactttgctgaagttgcttatcagcttaaggagattttgggctgagacaatggggttttctagatatacaatcatgtcatctgcaaacagggacaatttcacttcctcttttcctaattgaatgccctttatttccttctcctgcctgattgccctggccagaacttacaacactatgttgaataggagtggtgagagagggcatccctgccttgtgccagttttcaaagggaatgcttccagtttttgtccactcagtatgatattggctgtgggtttgtcatagatagctcttattattttgagatatgtcccatcaatacctaatttattgagagtttttagcatgaagcgttgttgaattttgtcaaaggccttttctgcatctattgagataatcatatggtttgtgtctttggttctgtttatatgctggattatgtttattgattttcgtatgttgaaccagccttgcatggcagggatgaagcccacttgatcatggtggatcagtttgccagtattttattgaggatttttgcatcaatgttcatcaaggatattggtgtaacattctctttttttgttgtgtctctgtcaggctttggtatcaggatgatgctggcctcataaaatgagttagggaggattccctctttttctattgattggaatagtttcagaaggaatggtaccagctcctccttgtacctctggtagaattcggctatgaatcctactggtcccggactttttttggttgataagctattaattattgcctcaatttcagagcctgttattggtctattcagagatacaacttcttcctggtttagtcttggcagagtgtatgtgtcgaggaatttatccatttcttctagattttctagtttatttgcgtagaggtgtttatagtattctctgacggtagtttgtatttctgtgggatcagtggtgataccccgtgtcattttttattgcgtctatttgattcttctctcttttcttctttattagtcttgctagcagtctatcaattttgttgatcttttcaaaaaaacagcttctggattcattgatttttttgaagggtttttttgtgtctctatgtccttcacttctgctctgatcttagttatttcttgtcttctgttagcttttgaatgtgtttgctcctgcttctctagttttttaattgtgatgttagggtgtcaattttagatctttcctgctttcccttgtgggcatttagtgctataaatttccctctacacactgctttgaatgtgtctcagagattctggtgtgttgtgtctttgttctcgttggtttcaaagaacatctttatttctgccttcattttgttatgtacccagtagtcattcaggagcaggctgttcagtttccatgtagctgagtggttttgagtgagtttcttaatcctgagttctagtttgattgcactgtggtctgagagacagtttgttatagtttctgttcttttacatttgctgaggagagctttacttccaactatgtggtcagttttggaataggtgtggtgtggtgctgaaaagaatgtatattctgttgatttggggtggagagttctgtagatgtctattaggtctgcttggtgcagagctgagtccaattcctggatatccttgttaactttctgtctcgttgatctgtctaatgttgacagtggggtgttaaagtctcccattattattgtgtgggcatctaagtctctttgtaggtcactcaggacttgttttatgaatctgggtgctcctgtattgggtgcatatatatttagtatagttagttcttcttcttgaatagatccctttgccattatgtaatggccttctttgtctcttttgatctttgttggtttaaaatctgttttatcagagactaggattgcaacccctgcctttttttgttttccatttgcttggtagatattcctccatccttttatttcgagcctatgtgtgtctctgcacgtgagatgggtttcctgaatacagaacacagatgggtcttgactccttatccaatttgccagtctgtgtcttttaattggagcatttagcctatttacatttaaggtgagtattgttatgtatgaatttgatcctgtcattatgatgttagctggttattttgctcgttgatgcagtttcttcctagccttgatggtctttacaatttggcatgtttttgcagtggctgatactagttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaacaatgttgaatattggcccccactttcttctggcttgtagagtttctgccgatagatcagctgttagtctgatgggcttccctttgtgggtaacccgacctttctctctggctgcccttaacattttttccttcatttcaactttggtgaatctgacagttatgtgtcttggagttgcttttctctaggagtatctttgtggcgttctctgtatttcctgaatgtgaatttgggcttgccttgctagattggggaagttctcctggataatatcctgcagagtgttttccaacttggttccattctccccatcactttcagctacaccaattagatgtagatttggtcttttcacatagtcccatatttcttggaggctttgttcgtttctttttattcttttttctctaaacttctcttcatgcttcatttcattcatttcatctttcgtcattgataccctttcttccagttgatctcatcggttactgaggcttgtgtatttgtcacgtagttctcctgccttggttttcagctccatcaggtcctttaaggacttctgtgcattggttattctagttatccattcatctaattttttttcaaagttttttacttctttgccgtttgttcgaacttcctcctttagcttggagtagtttgatcttctgaagccttcctctctcaactcgtcaaagtcattctctgcccagctttgttccattgctggtgaggagctgcgttactttggaggaggagaggcactctcatttttagagtgtccagtttttctgctctgctttttccccatctttatggttttatctacctttggtctttgatgatggcgatgtacagatgggtttttggtgtggatgtcctttctgtttgttagttttccttctaacagtcaggaccctcagctgcaggtctgttggagtttactggaggtccactccagaagctgttttcctgggtatcaacagcggtggctgcagaacagtggatattggtgaaccgcaaatgctgctgcctgatcattcctctggaagttttgtcttagaggagtaccagccatgtgaggtgtcagtctgcccctactgggggatgcctcccagttaggctactcgggggtcagggacccacttgaggaggcagtctgcctgttctcagatctgaagctatgtgctgggagaaccactactctcttcaaagctgtcagacagggacatttaagtctgcagaggttcttgttgtcttttgtttgtctgtgccctgcccctagaggtggagcctacagaggcaggcaggcctccttgagctgtggtgggctccacccagttcgagcttccaggcggctttgtttacctgctcaagcctggacaatggtgggcacccctcccccagcctcactgccaccttgcagtttgacctcagactgctgtgctagcaatgagcgaggctccatgggcgtaggaccctctgagccaggcatgggatataatctcctggtgtgccatttgttaagcttgttggaagagcgcagtattagggcgggagtgacccgattttccaggtgccatctgtcacccttttctttgactaggaaagggaattccctgaccccttgtgcttcccgggtgaggtgatgcctcgccctgctttggctcatgcacagtgcactgcacctactgtcctgcacccactgcctggcacttccctgtgagatgaacctggtacctcagttggaaatgcagaaatcacccgtcttctgcgtcactcacgatgggagctatagactggagctgttcctattcggtcatcttggctccaccgctccccccccccttttttttttcttttttttttgtgacggagtctcatgctgtcacctgggctggaatgcagtggcacaatcttggctcactgcaacctctgcctcccaggatcaagcgattctcctgcctcagcctcccaaattgctgggattacacatgcctgccaccacgccaggctaagtttttatatttttagtagcgatgaggtttcactatgttggccaggctgatcttgaactcctgacgtcgtgatccgcctgtctaggcctcccaaagtgctgcaattgcaggtgtgagccaccgctcccagcctagaataacttcttaaatgcttttattgttgactgaatttatttctcccttgatagtttctactttgggttgataattaaataacagtgttatctctaagattatatacatgtcttcccatatttttattctagttttttcgtgactgaattttaccttcacacctaattgtgtaatcgattgtggtatatgcagttaagcatttcactttactcttttcaaaaagtatagttgttcaattactgtttgttttttatttccaagctaaatttaaaagctatatttttatatatcacattattatattttagtgagatttagtttttggatttctatttattccactatcttacttacacatgagtggtattaatttaacatgattttagaatgaagaaaatgaagccatttttagataaaccaaaagtaacaatgtatttccagcagaaagagataatattaaggataatcagaaaaaaatagaataaacttagagagaatgttagaaatgaagaaaagcatgcaaaacattttgtacataagtgtaaacatttcttcactatttaataataacactagaaaatctagggagtaaaactatacaaaatatctaaaatatatatatatataattatagattgggaaggggaaaatgaagataaagtgctaaaatttattgtattgttttggaaaagagtaaacagtcaaatggatatttgtatctgaaaaatcaagaatgcaattctaatcatcaagatgcatttttttattttttagttttttaattcatgtgatgtctattcttttttattattcttcaactttattgaggtatcattcacaaataaaaattgtatatatttaaggtgtacaacatgatgttttaatatatgtataccttgtgaaatgattaccacaatcaagctaattaacatacccattatctcacatagttacctttttcttgtggtaaatgcttttaagatctactctcggccaggcccggtggctcacgcctgtaatcccagccctttgggtggccgaggcaggcggatcagcctgaccaacatggagaaaccccgtctctactaaaaatacaaaattagctgggcatggtgtcgcatgcctgtaatcccagctactcgggaggctgaggcaggagatttgcttgaacccaggaggcggaggttgcagtgagccaagatcttgccattgcactccagcctggacaacaagagcaaaactccatctaaaaaaaaaaaaaaatctactctctttgcaaattttaaatatacttacagtacaattaactacagtcacgatgctgtacattagatatctagaatttattcatcccacataactgaaattttataccctttgagtaatagtttcctgattctcccacccccaacccctggaaaccatacctctactgtctgtttccatgagagtgacttttttatgtttcacatatgagcaaggttgtgtagtatttgtctttttgtgtcaggcttatttttcttagttttacatcctccaggttcatcaattctgccataaatggcaggattttcttctttttaatttttttattttcctatttttaattttttgtttgttattgaatcatctgtgtttcttatatattttggatattaaccaaaatatttaagaaatatttggtttgcaaatatgccatttcatggttcacctttcatttgttcattgttttgttttttgtgtggaaattttttagtttgatgtagcctcacttctttatttttccttttgttgcctttgcttctcatatcaaattcaaaaaacggctgcaacgtgaatattagaattttcttcttttgatttctttaaaaatttttatggttttaggtcttagtttaattctttaacccattcaaatttatttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccgcctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcatatgcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttagtgatacttgtgggccagggcattagccacaccagccaccactttctgataggcagcctgcactggtggggtgaattctttgccaaagtgatgggccagcacacagaccagcacgttgcccaggagctgtgggaggaagataagaggtatgaacatgattagcaaaagggcctagcttggactcagaataatccagccttatcccaaccataaaataaaagcagaatggtagctggattgtagctgctattagcaatatgaaacctcttacatcagttacaatttatatgcagaaatatttatatgcagagatattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtacacatattaaaacattacactttaacccataaatatgtataatgattatgtatcaattaaaaataaaagaaaataaagtagggagattatgaatatgcaaataagcacacatatattccaaatagtaatgtactaggcagactgtgtaaagtttttttttaagttacttaatgtatctcagagatatttccttttgttatacacaatgttaaggcattaagtataatagtaaaaattgcggagaagaaaaaaaaagaaagcaagaattaaacaaaagaaaacaattgttatgaacagcaaataaaagaaactaaaacgatcctgagacttccacactgatgcaatcattcgtctgtttcccattctaaactgtaccctgttacttatccccttcctatgacatgaacttaaccatagaaaagaaggggaaagaaaacatcaagcgtcccatagactcaccctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaacctctgggtccaagggtagaccaccagcagcctaagggtgggaaaatagaccaataggcagagagagtcagtgcctatcagaaacccaagagtcttctctgtctccacatgcccagtttctattggtctccttaaacctgtcttgtaaccttgataccaacctgcccagggcctcaccaccaacttcatccacgttcaccttgccccacagggcagtaacggcagacttctcctcaggagtcagatgcaccatggtgtctgtttgaggttgctagtgaacacagttgtgtcagaagcaaatgtaagcaatagatggctctgccctgacttttatgcccagccctggctcctgccctccctgctcctgggagtagattggccaaccctagggtgtggctccacagggtgaggtctaagtgatgacagccgtacctgtccttggctcttctggcactggcttaggagttggacttcaaaccctcagccctccctctaagatatatctcttggccccataccatcagtacaaattgctactaaaaacatcctcctttgcaagtgtatttacgtaatatttggaatcacagcttggtaagcatattgaagatcgttttcccaattttcttattacacaaataagaagttgatgcactaaaagtggaagagttttgtctaccataattcagctttgggatatgtagatggatctcttcctgcgtctccagaatatgcaaaatacttacaggacagaatggatgaaaactctacctcggttctaagcatatcttctccttatttggattaaaaccttctggtaagaaaagaaaaaatatatatatatatgtgtgtatatatacacacatacatatacatatatatgcattcatttgttgttgtttttcttaatttgctcatgcatgctaataaattatgtctaaaaatagaataaatacaaatcaatgtgctctgtgcattagttacttattaggttttgggaaacaagagataaaaaactagagacctcttaatgcagtcaaaaatacaaataaataaaaagtcacttacaacccaaagtgtgactatcaatggggtaatcagtggtgtcaaataggaggttaactggggacatctaactgtttctgcctggactaatctgcaagagtgtctgggggaacaaaaagcctctgtgacttagaaagtaggggtaggaggggaaaaggtcttctacttggctcagattatttttttcctctagtccactaagaatactgcgttttaaaatcatttccttgattcaagttcctatttctctttatattttgtttgtttaaacctcctttactaaaatttactcttctttctctatagcttcccaacgtgatcgcctttctcccatccccctgtactttttccccttgtactaaattaactcctcaggtgaggaaaaacttttgaagtgcagagttctgcttcctgctattaaaagatgtaattaaaacagcaaaggtagcaagcatttatgaggtcagcgtagggtctcagtgttccctaagggccctgtcagtcatcctgaatcctgcccctacctggaaacccatgtcggtttagtaaggaaagtgttatacttttactttgcatgtttctcctacttcttcctttcagctctaacactctgaaactacgattacacaaaataaaataaaataaaataaaataaaacaataaaatgaaataaaatttaggttaaccaaaagaaactggatcctctatttctagttatcagaaggaaatttacaaatttcttatttccattgctttattctcttaaatgctttctctattattgctaaataaatagagatctctcactttttctacctgtctcaaccctcatcaggtacttgtgaaaaaatctcactctgattattctcacacacgcagaaagtgtttggttcttctatggctatctggagcctaggttaaaaaattatgcctatgtatgattatagaggtaagagggataaaatttaagtattttctttttatattcattcctctgtaaaaaactaaagcaatgaggatctaggcacacgtgtatccctgagaaaagatttcacatgttgaatcctgggaaaagacgtctttaaaatattttaaatgttaaaacatgcagatttgacttggctgttagattttggattttattttattaaatttaaacctgcattagcattgttttagatttagacagttttcaagaccctgtttcacatccctgatataagaggcatgtatatgtgaaataaagtgttctgcggaagtttgaatatgtcttttgcaaatatcctgggtcaaagaaaatgcacagactttatgaaattataatataggttatatttatagtattctgaaagaccaaaattgtcaaagcaagagctttgaaatcctgattggcagaaattgtcaccttcttaaagacttaccctacaacttcttatgctcagaaatagttttcctttttctattttgttttcttttttaaatgatgaactatggatccttctcttgtgttggcaactgctgcagataccatcatcctggcttcaaggcaggggttgcttttccaatggtagttacttagtgtgactagagtgtaacgcagacttttctttctattacccataataccctgcagggacaaggctgcaagctatactaagaccatcaaaagcccaggcataccaggcaaataagtttcaagaagcaataaatagtgcaaatttggttatggtcagagcctcagtttcaaatctaaatcagcattcaaagttcctgaaaaactattcaagcttactgacatcttcactattgtgagcttgcttctactctgtgaatggatgccacagcaggtgcaggtctattctacttttattccagccccactgaccacaacacacacacacacacacacacacacacacacacaagtcctcaaaaaagagacagcgagagagacagaggtccatttcctttactccagtctattaatctttcttaagtcctaatgttttatatcagaatggccctagtctgggtatacttagaggatgaatattaacttcctccatgaaaatcatgacactcatctatgggagtgtggttttatcatttgtttcaaaagcagcacttgactagagtatttttatacatgctctactgtttagtctaaaattccccaagtgagacattttagcaatctactgtatatgttcctaggtcaagcacagtctagctacttgctacagacttctctcgcagatacacaatctctcagtaaacacaactcagcagctctcagaattaattaattaaaatgaaataaaaatgctccaagaaaaccagaacccatagaaacaaaccgcacacacacaaaatagtttggaaataggatagtttagttcactttaaaaagttgtatttcttaccaaaaagcaataaagtcaacatagacagaactttgctaaagtatatgcataattattacagaaaaatttatatttcagtctgcaccttgttcattaatatttcctccactgggctcagattttcattcagaattagcttttttttaacctcattaagtgggccatggtgtcaatttatggagagcagaggtacagtcttcagataaatttgagattgcatctctttagaggtagaatcttggcttcagtctgaacaccctttacaaacatgtaggcattaattcagaggactgctctgaagctcaagagatggatgatttaggagactattaggcttaattctcctgacattaaattattttattgaaaaattttcatgaactcaaattcacattattacgtcctctcttcccttcctctctccctctctttcacacacacacacaccctttcattcagacatactgaacatagtttataaagcaacgccatagtgagaaaagaaaaacaaccatttgataaattatcaaataaaattaaagccaaatcttgaggaattaattccattcctatactttgttttaactttcattttaaatttgggggtacatgtacaagttatataggtaaattgcatatcactgggtcttgatgtacagattatttcatcactcagtgatgaacttaatacccaataggttctttttcatcgtctccctcttcccaccctcaaccctcaagtaggcctgggtgtctgttgatctattttttgtgtccatgtgtatcatcatttagctcccacactcctagactcttacaaaagctctactctaacaaataattttaatataacaacaaggtgccaagtcttttttcatctcttgacctcctcatcttcaatatgaagatagcaatgcctagcatatagtaattgtgtgtgctcggcacatgtcccatccaggtgatgttctcatgaattctctggtatttggatttttagggccaacatcttgcctagactcactgactacttctaatggtgtaggaatagaaggtatagtaagctatatttgctctttttttttgacttttggagaaaggaatgtagtttgttttccctatcaagatcataaggtctacaatctctcttactgtctttcgaataccacacaagtatctccttttaatatcttactcttatgagaacttccctatgctcaggaatgtgaaagtgatcttccccaaaatgccctgagtagctctgcttctgatatgtaaaccagtggttcctaaatatcttattcagatataaagagttctcagtgcctactatgtataatgacttaaggaaaacacatggatataaaagagcttctgctgccagtcaattcaaaatgttgtgatcaaaacagttaactataacacattgtcagtatattctggcagtacagacagagttactgtgaaagcactttcaaacacaaggaaacaacagattctgtttaggtattcaagtaagtttaaaattaatcaacatgcatataatacagatttttaaaaatgtatacaactgagaaagttctaaaaatccttctaattttacctatggcaaaaatggtgctcaaggaaaaaaatattactcctatgatcagaaaggaaataactgttcggttgtttactgcatgcttcctctttgtatgttgtagcattaacaacaaagaaacactgtgcgatggtattattaatattgtcctctaattccagaagttctaaagcaaggaataatcattccttcatttactcatttactcattcgttcattcattcactgttttcttgaataaatattttctttctgcccattgatgaatttaatatgaggcacagtaggcatgtaagaaggtagagaataggcagaattgcttataaagcacggagtgtgtgtgtgtgcatgaaataaataagaaaaatataaaaatataaaaaatggtgtgggggagggtttggaaagattttttgggtagtatagagaagtttattgtggctggggtcaagagaggtcacaagtaatacgtgagcaatgaatcttgactgaaatatgggaagataagaggaaattctttacagagatgttctggggcaagtaagaggaggaagctatttcttggagcaggaacacttgatggggtatagtattatgggctacaatgtgcaggcaaaggaaggaggaagaaagacaacataacattgtcttgagtaatcattatgcctttaattgagcacattattttctcagtaattgttggagtttaatcgtagcattacccttgaggctatgtcttagggttgaggtcttccctagaacctctgcagtgccagtattatctttgtatcaagagttcttgataatttctgctctttggaggtagaagtgtcacccattaatgccttgtacggttcccttgcttttctcttttcccatgtactctttgtaaaataaacaagtgctccctatctgtagagcctcaggaaccttcttacacacctggacaaaaaaatgaaataagtgaaattaatcaggaagttgagctgaacattctttattaggcagaagccatacccttgaagtaggcattgtgttcccaagttcagaaaatagaatctagggaaatagggtcttcttatggttatcaggaaacagtccaggatctcaatggtacttgtgagccagggcattagccacaccagccaccaccttctgataggcagcctgcatttgtggggtgaattccttgccaaagttgcgggccagcacacacaccagcacattgcccaagagctgcggagaagaggtaggcagatacatgcatatggttaacagagaaataaagactggcttctgagaaactgagccaacacccatttttttctgcccaaatcttagacaaaactgatccccaggttattcccatcagcataaataagtacatatatgaatgcatacatataacatatatctatacacacacatcctctatgtacttaactagcatgtagtctatatatgtacatatatgctatatatgctgtataatactatatacaaattaattccaaattagttttaattttgtatgtgtatatagcatatacaaattaattactataaacagattaatagatacaaattaattgattaatcagtgtgatgatgggctgtctcctagcaacgacttctgccccacctccagtgtaactgcctagtctttcataatcaaatattcactttcctttccattccatttactacagaatttataaaattccaattattccttattgtaaaatgatttatagcctctaaaacagtattctatgcctctcatctttgagttggagcctctcccatacccatgtggagagacaaaaggattattctaagtgcagaattagcaggtgagagctggtatgcataatttgagttgttgttagagaaggaaaaatgaagggagggggttgggagagaaagacaggatattaaataatttaaaatagcaagattgtgaggaaggaaaaaatgcagaatatttaaataaaaaattaacaaaattttagaagcattaaatgataaaatatagtaaaatgacaaaaatgtgggagaagagcaggtaggtaaaagaaccaaaatgtaagattagaaagtaaaaagagaaaagtgaagcatctcctggactcaccctgaagttctcaggatccacgtgcagcttgtcacagtgcagctcactcagctgagaaaaagtgcccttgaggttgtccaggtgagccaggccatcactaaaggcacctagcaccttcttgccatgagccttcaccttagggttgcccataacagcatcaggagaggacagatccccaaaggactcaaagaacctctgggtccaagggtagaccaccagtaatctgagggtaggaaaacagcccaagggacagagagtcagtgcctatcagaaacccaagagtcttctctgtctacacatgcccagtttccatttgcctccttgagcctctcttataaccttgataccaacctgcccagggcctcaccaccaactgcatccacgttcactttgccccacagggcattgacagcagtcttctcctcaggagtcagatgcaccatggtgtctgtttgaggttgctagtgaacactgttatgtcagaagaaagtgtaagcaacagtcgactctgccctgccttttatgctggtcctgtcctccctgctccagtgagcaggttggtttaagataagcagggtttcattagtttgtgagaatgaaaaatgaaccttcattccactattcccttaacttgccctgagattggctgttctgtcatgtgtgtcttgactcagaaaccctgttctcctctacatatctccccaccgcatctctttcagcagttgtttctaaaaatatcctcctagtttcatttttgcagaagtgttttaggctaatatagtggaatgtatcttagagtttaacttatttgtttctgtcactttatactaagaaaacttatctaaaagcagatgttttaacaagttgactcaatataaagttcttctttgcctctagagatttttgtctccaagggaattttgagaggttggaatggacaaatctattgctgcagtttaaacttgcttgcttcctccttcttttggtaaattcttcctataataaaactctaattttttattatattgaaataaatatccattaaaagaatatttaaaaaatgaatagtgtttatttaccagttattgaaataggttctggaaacatgaattttaaggttaacattttaatgacagataaaatcaaatattatatacaaatattttgaatgtttaaaattatggtatgactaaagaaagaatgcaaagtgaaaagtagatttaccatattcagccagattaaatttaacgaagttcctgggaatatgctagtacagaacatttttacagatgtgttcttaaaaaaaaatgtggaattagacccaggaatgaagatcccagtagtttttcactcttttctgaattcaaataatgccacaatggcagacaaatacacacccatgagcatatccaaaaggaaggattgaaggaaagaggaggaagaaatggagaaaggaaggaaggaagaggggaagagagaggatggaagggatggaggagaagaaggaaaaataaataatggagaggagaggagaaaaaaggaggggagaggagaggagaagggatagggaagagaaagagaaagggaagggaagagaggaaagaagagaagaggagagaaaagaaacgaagagaggggaagggaaggaaaaaaaagaggaaaaaagagacaagagaagagataagactgacagttcaaattttggtggtgatatggatcaatagaaactcaaactctgttggtgacactgtacaatagtataacccctttggaaaacctttaatagtatccacaaatgctggatgcttgataagtctattacctagcaattacatttttagatattcagaaacacatgcatgtgtgtatccaaagacatgtatagaaatgcttatgacagcaataatcataaaaacctcaaaccggtagccacttaaatgcttaccaacagtagaattgataaattacggtatagtcaaagaatagaatattacacagaaatgaaaagaatcaactactgcttaacacgtagcgatacaaatgcattttacagcatttggttgattaaaagtaaccagaggtgagttcaaactatatgactttatttgtatatagaaagatggatgatgtgcctgagattctgatcacaaggggaaatgttataaaatagggtagagaggagccatgaatgacctttaaactttgttacaagttatttttctgtaacctggaagccaacgaaagatattgaataattcaagaaaggtggtggcatggtttgatttgtgtctttaaaagattattctcacttagtgaagaaatgtattttagaagtagagaaaatgggagacaaatagctgggcttctgttgcagtagggaagaaagtgacaatgccatttctattatcagacttggaccatgacggtgatgtcagtcgtgaacacaagaatagggccacatttgtgagtttagtggtacgataaaatcagaaatacagtcttggatacattgtattgtatgcactcttgtaaaatgcaaaaagatgtacttagatatgtggatctggagctcagaaagaatacaaccaggtcaagaatacagaatggaacagaacatacaagaacagatcataatgtgctgtgtgaatcactaccactacctgttaaaaatgacagatgatgtacttcatcaatatctccttaaaatcttagaatgtgtttgtgagggaggaattatgtttccaattcatatataagaaaattgattctaaaaaaaatgttaggtaaattcttaaggccatgaggactgttatttgatctttgtctgttaattccaaagacttggcttttcactttaattctgttctacctgaaatgattttacacattgggagatctggttacatgtttattctatatggattgcattgagaggatttgtataacagaataaggtctttttttcttttctcttctgagatggagtttcatccctattgcccaagctagagtgcaatggtgcaatctaggctcaccgcaacctctgcctcctgggttcaagcaattctcctgcctcagccacctgaatagctgggactgcaggcatgcaccacacgcccggctgattttgtatttttagtagagatggggtttcaccatgttggtcaggctggtcttgaactcctgacctcaagtgatctgcctgccttggcctcccaaagtgctgggtttacaagcctgagccaccgcatccagccaggataaggtctaaaagtggaaagaatagcatctactcttgttcaggaaacaatgaggacctgactgggcagtaagagtggtgattaatagatagggacaaattgaagcagaatcgaactgttgattagaggtagggaaatgattttaatctgtgaccttggtgaatgggcaagtagctatctaatgactaaaatggaaaacactggaagagaaacagttttagtataacaagtgaaatacccatgctgagtctgaggtgcctataggacatctatataaataagcccagtacattgtttgatatatgggtttggcactgaggttggaggtcagaggttagaaatcagagttgggaattgggattatacaggctgtatttaagagtttagatataactgtgaatccaagagtgtgatgaatacaaagttaaatgaaggacctttaatgaacaccaacatttaatgtgaaatctcaaggaagtatgaagtaagacatagtccccaaaatccccgatgattttagaactcagtatcgattttaattagtgtaatgccaatgtgggttagaatggaagtcaacttgctgttggtttcagagcaggtaggagataaggttctagattttgacacagtgaaaagctgaaacaaaaaggaaaaggtagggtgaaagatgggaaatgtatgtaaggaggatgagccacatggtatgggaggtatactaaggactctagggtcagagaaatatgggttatatccttctacaaaattcacattcttggctgggtgtggtggctcacgcctgtgatcccagcactttcagaggccgaggagggtggatcacctgatgttaggagttcgagatcagcctgaccaacatggtgaaaccccctatctactaaaaatagaaaattagccaggcatggtggtggcacatgcctgtagtgccagctacttgggaggctgaggcaggagaatcgcttgaacctgggaggcagatgttgcagtgagcctggatcatgccattgcactccagcctgggcaaccatagcaatgctctatctcagaaaaaaaaaaaaaaagttcttgctaacctgaaaaaataaattatttgagctttgtacctaattcataattttcagataatgaatattgagatgatatatgcacagaacaatgcctagagacacattctaagtgtgacattcttaaatgccagtgctctccacaattctaatctcagttcactgctgtttgaattctgtgttttcatattatcttatcaatacattaatcattgcaataatcactgcacactgtaattattcatttactggacacatcctagtttccttctgtcaattaccattcatgtctgctttcacatttatttctcatccttccctcagtgttctctgtatttgaggaactgacatttcccaggtttcctcaccctttcagtcgcatgtacattctgcaatggtaaacactggctgagggaaagcataagcaagattatttctggtctctctctctctctgaacggatctcctacagcagacagtcttttttatggttttttatggctgatactttgatgcccccattagacagttctggctctctccaaggagcacccactagctcactgaatccagtggacctctggttatgggctctggttctggactctggtggtataaacattttctccttctgcccttctaggcctaatggcggaagaggttttctgatgttactaacatctagatttctgcactgtcctttatttgatattttagctcttccaatacaaggataattaac

SEQ ID NO: 3 - DNA, 25800 bp, Homo sapiens
tcttgatgatatgttaaacaagttttggattatttatgccttctctttttaggccatatagggtaactttctgacattgccatggcatttttcttttaatttaatttactgttaccttaaattcaggggtacacgtacaggatatgcaggtttgttttataggtaaaagtgtgccatggttttaatgggttttttttttcttgtaaagttgtttaagtttcttgtttactctggatattaggcctttgtcagaagaatagattggaaaatctttttcccattctgtagattgtctttcgctctgatggtagtttcttttgctgagcaggagctctttagtttaattagattccattggtcaatttttgcttttgctgcaattgcttttcacgctttcatcatgaaatctgtgcccgtgtttatatcatgaatagtattgccttgatttttttctaggctttttatagtttggggtttttcatttaagtctctaatccatctggagttaattttggataaggtataaggaaggagtccagtttcatttttcagcatatggctagccagttctcccccatcatttattaaattgaaaatcctttccccattgcttgcttttgtcaggtttctaaaagaccagatggttgtaggtacaatatgcagtttcttcaagtcatataataccatctgaaatctcttattaattcatttcttttagtatgtatgctggtctcctctgctcactatagtgagggcaccattagccagagaatctgtctgtctagttcatgtaagattctcagaattaagaaaaatggatggcatatgaatgaaacttcatggatgacatatggaatctaatatgtatttgttgaattaatgcataagatgcaacagagagaagttgacaactgcaatgataacctggtattgatgatataagagtctatagatcacagtagaagcaataatcatggaaaacaattggaaatggggaacagccacaaacaagaaagaatcaatacttccaggaaagtgactgcaggtcacttttcctggagcgggtgagagaaaagtggaagttagcagtaactgctgaattcctggttggctgatggaaagatggggcagctgttcactggtacgcagggttttagatgtatgtacctaaggatatgaggtatggcaatgaacagaaattcttttgggaatgagttttagggccattaaaggacatgacctgaagtttcctctgaggccagtccccacaactcaatataaatgtgtttcctgcatatagtcaaagttgccacttctttttcttcatatcatcgatctctgctcttaaagataatcttggttttgcctcaaactgtttgtcactacaaactttccccatgttcctaagtaaaacaggtaactgcctctcaactatatcaagtagactaaaatattgtgtctctaatatcagaaattcagctttaatatattgggtttaactctttgaaatttagagtctccttgaaatacacatgggggtgatttcctaaactttatttcttgtaaggatttatctcaggggtaacacacaaaccagcatcctgaacctctaagtatgaggacagtaagccttaagaatataaaataaactgttcttctctctgccggtggaagtgtgccctgtctattcctgaaattgcttgtttgagacgcatgagacgtgcagcacatgagacacgtgcagcagcctgtggaatattgtcagtgaagaatgtctttgcctgattagatataaagacaagttaaacacagcattagactatagatcaagcctgtgccagacacaaatgacctaatgcccagcacgggccacggaatctcctatcctcttgcttgaacagagcagcacacttctcccccaacactattagatgttctggcataattttgtagatatgtaggatttgacatggactattgttcaatgattcagaggaaatctcctttgttcagataagtacactgactactaaatggattaaaaaacacagtaataaaacccagttttccccttacttccctagtttgtttcttattctgctttcttccaagttgatgctggatagaggtgtttatttctattctaaaaagtgatgaaattggccgggcgcggtggctcacacctgtaatcccagcactttgggaggctgaggtgggcggatcacgaggtcaggagatcaagaccatcctggctaacatggtgaaaccccatctctactaaaaatacaaaaaattagccagagacagtggcgggtgcctgtagtcccagctactcgggaggctgaggcaggagaatggcgtgaacctgggaggcagagcttgcggtgagcagagatcgcgccactgcacactccagcctgggtgacaaagcgagactccatctcaaaaaaaaaaaaaaaaaaaagaaaaagaaagaaagaaagaaaaaaaaactgatgaaattgtgtattcaatgtagtctcaagagaattgaaaaccaagaaaggctgtggcttcttccacataaagcctggatgaataacaggataacacgttgttacattgtcacaactcctgatccaggaattgatggctaagatattcgtaattcttatccttttcagttgtaacttattcctatttgtcagcattcaggttattagcggctgctggcgaagtccttgagaaataaactgcacactggatggtgggggtagtgtaggaaaatggaggggaaggaagtaaagtttcaaattaagcctgaacagcaaagttcccctgagaaggccacctggattctatcagaaactcgaatgtccatcttgcaaaacttccttgcccaaaccccacccctggagtcacaacccacccttgaccaatagattcattttactgagggaggcaaagggctggtcaatagattcatttcactgggagaggcaaagggctgggggccagagaggagaagtaaaaagccacacatgaagcagcaatgcaggcatgcttctggctcatctgtgatcaccaggaaactcccagatctgacactgtagtgcatttcactgctgacaagaaggctgctgccaccagcctgtgaagcaaggttaaggtgagaaggctggaggtgagattctgggcaggtaggtactggaagccgggacaaggtgcagaaaggcagaaagtgtttctgaaagagggattagcccgttgtcttacatagtctgactttgcacctgctctgtgattatgactatcccacagtctcctggttgtctacccatggacctagaggtactttgaaagttttggatatctgggctctgactgtgcaataatgggcaaccccaaagtcaaggcacatggcaagaaggtgctgatctccttcggaaaagctgttatgctcacggatgacctcaaaggcacctttgctacactgagtgacctgcactgtaacaagctgcacgtggaccctgagaacttcctggtgagtagtaagtacactcacgctttcttctttacccttagatatttgcactatgggtacttttgaaagcagaggtggctttctcttgtgttatgagtcagctatgggatatgatatttcagcagtgggattttgagagttatgttgctgtaaataacataactaaaatttggtagagcaaggactatgaataatggaaggccacttaccatttgatagctctgaaaaacacatcttataaaaaattctggccaaaatcaaactgagtgtttttggatgagggaacagaagttgagatagagaaaataacatctttcctttggtcagcgaaattttctataaaaattaatagtcacttttctgcatagtcctggaggttagaaaaagatcaactgaacaaagtagtgggaagctgttaaaaagaggattgtttccctccgaatgatgatggtatacttttgtacgcatggtacaggattctttgttatgagtgtttgggaaaattgtatgtatgtatgtatgtatgtatgtgatgactggggacttatcctatccattactgttccttgaagtactattatcctactttttaaaaggacgaagtctctaaaaaaaaaatgaaacaatcacaatatgttggggtagtgagttggcatagcaagtaagagaaggataggacacaatgggaggtgcagggctgccagtcatattgaagctgatatctagcccataatggtgagagttgctcaaactctggtgaaaaaggatgtaagtgttatatctatttactgcaagtccagcttgaggccttctattcactatgtaccattttcttttttatcttcactccctccccagctcttaggcaacgtgatattgattgttttggcaacccacttcagcgaggattttaccctacagatacaggcttcttggcagtaactaacaaatgctgtggttaatgctgtagcccacaagaccactgagttccctgtccactatgtttgtacctatggtccactatgtttgtacctatgtcccaaaatctcatctcctttagatgggggaggttggggagaagagcagtatcctgcctgctgattcagttcctgcatgataaaaatagaataaagaaatatgctctctaagaaatatcattgtactctttttctgtctttatattttaccctgattcagccaaaaggacgcactatttctgatggaaatgagaatgttggagaatgggagtttaaggacagagaagatactttcttgcaatcctgcaagaaaagagagaactcgtgggtggatttagtggggtagttactcctaggaaggggaaatcgtctctagaataagacaatgtttttacagaaagggaggtcaatggaggtactctttggaggtgtaagaggattgttggtagtgtgtagaggtatgttaggactcaaattagaagttctgtataggctattatttgtatgaaactcaggatatagctcatttggtgactgcagttcacttctacttattttaaacaacatattttttattatttataatgaagtggggatggggcttcctagagaccaatcaagggccaaaccttgaactttctcttaacgtcttcaatggtattaatagagaattatctctaaggcatgtgaactggctgtcttggttttcatctgtacttcatctgctacctctgtgacctgaaacatatttataattccattaagctgtgcatatgatagatttatcatatgtattttccttaaaggatttttgtaagaactaattgaattgatacctgtaaagtctttatcacactacccaataaataataaatctctttgttcagctctctgtttctataaatatgtacaagttttattgtttttagtggtagtgattttattctctttctatatatatacacacacatgtgtgcattcataaatatatacaatttttatgaataaaaaattattagcaatcaatattgaaaaccactgatttttgtttatgtgagcaaacagcagattaaaaggctgagatttaggaaacagcacgttaagtcaagttgatagaggagaatatggacatttaaaagaggcaggatgatataaaattagggaaactggatgcagagaccagatgaagtaagaaaaatagctatcgttttgagcaaaaatcactgaagtttcttgcatatgagagtgacataataaatagggaaacgtagaaaattgattcacatgtatatatatatatagaactgattagacaaagtctaacttgggtatagtcagaggagcttgctgtaattatattgaggtgatggataaagaactgaagttgatggaaacaatgaagttaagaaaaaaaatcgagtaagagaccattgtggcagtgattgcacagaactggaaaacattgtgaaacagagagtcagagatgacagctaaaatccctgtctgtgaatgaaaagaaggaaatttattgacagaacagcaaatgcctacaagccccctgtttggatctggcaatgaacgtagccattctgtggcaatcacttcaaactcctgtacccaagacccttaggaagtatgtagcaccctcaaacctaaaacctcaaagaaagaggttttagaagatataataccctttcttctccagtttcattaatcccaaaacctctttctcaaagtatttcctctatgtgtccaccccaaagagctcacctcaccatatctcttgagtgggagcacatagataggcggtgctaccatctaacagcttctgaaattcctttgtcatatttttgagtccccactaataacccacaaagcagaataaataccagttgctcatgtacaataatcactcaactgctgtcttgtagcatacattaattaagcacattctttgaataattactgtgtccaaacaatcacactttaaaatctcacacttgtgctatcccttgcccttctgaatgtcactctgtattttaaatgaagagatgagggttgaatttcctgtgttacttattgttcatttctcgatgaggagttttcacattcacctttagtggaaaacacataagtacacatcttacaggaaaaatataccaaactgacatgtagcatgaatgcttgtgcatgtagtcatataaaatcttgtagcaatgtaaacattctctgatatacacatacagatgtgtctatatgtctacacaatttcttatgctccatgaacaaacattccatgcacacataagaacacacactgttacagatgcatacttgagtgcattgacaaaattaccccagtcaatctagagaatttggatttctgcatttgactctgttagctttgtacatgctgttcatttactctgggtgatgtctttccctcattttgccttgtctatcttgtactcatactttaagtcctaacttatatgttatctcaactaagaagctatttttttttaattttaactgggcttaaagccctgtctataaactctgctacaattatgggctctttcttataatatttagtgtttttcctactaatgtacttaatctgctcattgtatattcctaccactaaattttaacctcttttatggtagagacattgtcttgtaaactcttatttccctagtatttggagatgaaaaaaaagattaaattatccaaaattagatctctcttttctacattatgagtattacactatccatagagaagtttgtttgagacctaaactgaggaacctttggttctaaaatgactatgtgatatcttagtatttataggtcatgaggttccttcctctgcctctgctatagtttgattagtcaacaagcatgtgtcatgcatttattcacatcagaatttcatacactaataagacatagtatcagaagtcagtttattagttatatcagttagggtccatcaaggaaaggacaaaccattatcagttactcaacctagaattaaatacagctcttaatagttaattatccttgtattggaagagctaaaatatcaaataaaggacagtgcagaaatctagatgttagtaacatcagaaaacctcttccgccattaggcctagaagggcagaaggagaaaatgtttataccaccagagtccagaaccagagcccataaccagaggtccactggattcagtgagctagtgggtgctccttggagagagccagaactgtctaatgggggcatcaaagtatcagccataaaaaaccataaaaaagactgtctgctgtaggagatccgttcagagagagagagagaccagaaataatcttgcttatgctttccctcagccagtgtttaccattgcagaatgtacatgcgactgaaagggtgaggaaacctgggaaatgtcagttcctcaaatacagagaacactgagggaaggatgagaaataaatgtgaaagcagacatgaatggtaattgacagaaggaaactaggatgtgtccagtaaatgaataattacagtgtgcagtgattattgcaatgattaatgtattgataagataatatgaaaacacagaattcaaacagcagtgaactgagattagaattgtggagagcactggcatttaagaatgtcacacttagaatgtgtctctaggcattgttctgtgcatatatcatctcaatattcattatctgaaaattatgaattaggtacaaagctcaaataatttattttttcaggttagcaagaactttttttttttttttctgagatagagcattgctatggttgcccaggctggagtgcaatggcatgatccaggctcactgcaacatctgcctcccaggttcaagcgattctcctgcctcagcctcccaagtagctggcactacaggcatgtgccaccaccatgcctggctaattttctatttttagtagatagggggtttcaccatgttggtcaggctgatctcgaactcctaacatcaggtgatccaccctcctcggcctctgaaagtgctgggatcacaggcgtgagccaccacacccagccaagaatgtgaattttgtagaaggatataacccatatttctctgaccctagagtccttagtatacctcccataccatgtggctcatcctccttacatacatttcccatctttcaccctaccttttcctttttgtttcagcttttcactgtgtcaaaatctagaaccttatctcctacctgctctgaaaccaacagcaagttgacttccattctaacccacattggcattacactaattaaaatcgatactgagttctaaaatcatcggggattttggggactatgtcttacttcatacttccttgagatttcacattaaatgttggtgttcattaaaggtccttcatttaactttgtattcatcacactcttggattcacagttatatctaaactcttaaatacagcctgtataatcccaattcccaactctgatttctaacctctgacctccaacctcagtgccaaacccatatatcaaacaatgtactgggcttatttatatagatgtcctataggcacctcagactcagcatgggtatttcacttgttatactaaaactgtttctcttccagtgttttccattttagtcattagatagctacttgcccattcaccaaggtcacagattaaaatcatttccctacctctaatcaacagttcgattctgcttcaatttgtccctatctattaatcaccactcttactgcccagtcaggtcctcattgtttcctgaacaagagtagatgctattctttccacttttagaccttatcctggctggatgcggtggctcaggcttgtaaacccagcactttgggaggccaaggcaggcagatcacttgaggtcaggagttcaagaccagcctgaccaacatggtgaaaccccatctctactaaaaatacaaaatcagccgggcgtgtggtgcatgcctgcagtcccagctattcaggtggctgaggcaggagaattgcttgaacccaggaggcagaggttgcggtgagcctagattgcaccattgcactctagcttgggcaatagggatgaaactccatctcagaagagaaaagaaaaaaagaccttattctgttatacaaatcctctcaatgcaatccatatagaataaacatgtaaccagatctcccaatgtgtaaaatcatttcaggtagaacagaattaaagtgaaaagccaagtctttggaattaacagacaaagatcaaataacagtcctcatggccttaagaatttacctaacattttttttagaatcaattttcttatatatgaattggaaacataattcctccctcacaaacacattctaagattttaaggagatattgatgaagtacatcatctgtcatttttaacaggtagtggtagtgattcacacagcacattatgatctgttcttgtatgttctgttccattctgtattcttgacctggttgtattctttctgagctccagatccacatatctaagtacatctttttgcattttacaagagtgcatacaatacaatgtatccaagactgtatttctgattttatcgtaccactaaactcacaaatgtggccctattcttgtgttcacgactgacatcaccgtcatggtccaagtctgataatagaaatggcattgtcactttcttccctactgcaacagaagcccagctatttgtctcccattttctctacttctaaaatacatttcttcactaagtgagaataatcttttaaagacacaaatcaaaccatgccaccacctttcttgaattattcaatatctttcgttggcttccaggttacagaaaaataacttgtaacaaagtttaaaggtcattcatggctcctctctaccctattttataacatttccccttgtgatcagaatctcaggcacatcatccatctttctatatacaaataaagtcatatagtttgaactcacctctggttacttttaatcaaccaaatgctgtaaaatgcatttgtatcgctacgtgttaagcagtagttgattcttttcatttctgtgtaatattctattctttgactataccgtaatttatcaattctactgttggtaagcatttaagtggctaccggtttgaggtttttatgattattgctgtcataagcatttctatacatgtctttggatacacacatgcatgtgtttctgaatatctaaaaatgtaattgctaggtaatagacttatcaagcatccagcatttgtggatactattaaaggttttccaaaggggttatactattgtacagtgtcaccaacagagtttgagtttctattgatccatatcaccaccaaaatttgaactgtcagtcttatctcttctcttgtctcttttttcctcttttttttccttcccttcccctctcttcgtttcttttctctcctcttctcttctttcctctcttcccttccctttctctttctcttccctatcccttctcctctcctctcccctccttttttctcctctcctctccattatttatttttccttcttctcctccatcccttccatcctctctcttcccctcttccttccttcctttctccatttcttcctcctctttccttcaatccttccttttggatatgctcatgggtgtgtatttgtctgccattgtggcattatttgaattcagaaaagagtgaaaaactactgggatcttcattcctgggtctaattccacatttttttttaagaacacatctgtaaaaatgttctgtactagcatattcccaggaacttcgttaaatttaatctggctgaatatggtaaatctacttttcactttgcattctttctttagtcataccataattttaaacattcaaaatatttgtatataatatttgattttatctgtcattaaaatgttaaccttaaaattcatgtttccagaacctatttcaataactggtaaataaacactattcattttttaaatattcttttaatggatatttatttcaatataataaaaaattagagttttattataggaagaatttaccaaaagaaggaggaagcaagcaagtttaaactgcagcaatagatttgtccattccaacctctcaaaattcccttggagacaaaaatctctagaggcaaagaagaactttatattgagtcaacttgttaaaacatctgcttttagataagttttcttagtataaagtgacagaaacaaataagttaaactctaagatacattccactatattagcctaaaacacttctgcaaaaatgaaactaggaggatatttttagaaacaactgctgaaagagatgcggtggggagatatgtagaggagaacagggtttctgagtcaagacacacatgacagaacagccaatctcagggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcaggttggtatcaaggttataagagaggctcaaggaggcaaatggaaactgggcatgtgtagacagagaagactcttgggtttctgataggcactgactctctgtcccttgggctgttttcctaccctcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgagtccaggagatgcttcacttttctctttttactttctaatcttacattttggttcttttacctacctgctcttctcccacatttttgtcattttactatattttatcatttaatgcttctaaaattttgttaattttttatttaaatattctgcattttttccttcctcacaatcttgctattttaaattatttaatatcctgtctttctctcccaaccccctcccttcatttttccttctctaacaacaactcaaattatgcataccagctctcacctgctaattctgcacttagaataatccttttgtctctccacatgggtatgggagaggctccaactcaaagatgagaggcatagaatactgttttagaggctataaatcattttacaataaggaataattggaattttataaattctgtagtaaatggaatggaaaggaaagtgaatatttgattatgaaagactaggcagttacactggaggtggggcagaagtcgttgctaggagacagcccatcatcacactgattaatcaattaatttgtatctattaatctgtttatagtaattaatttgtatatgctatatacacatacaaaattaaaactaatttggaattaatttgtatatagtattatacagcatatatagcatatatgtacatatatagactacatgctagttaagtacatagaggatgtgtgtgtatagatatatgttatatgtatgcattcatatatgtacttatttatgctgatgggaataacctggggatcagttttgtctaagatttgggcagaaaaaaatgggtgttggctcagtttctcagaagccagtctttatttctctgttaaccatatgcatgtatctgcctacctcttctccgcagctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttcctgattaatttcacttatttcatttttttgtccaggtgtgtaagaaggttcctgaggctctacagatagggagcacttgtttattttacaaagagtacatgggaaaagagaaaagcaagggaaccgtacaaggcattaatgggtgacacttctacctccaaagagcagaaattatcaagaactcttgatacaaagataatactggcactgcagaggttctagggaagacctcaaccctaagacatagcctcaagggtaatgctacgattaaactccaacaattactgagaaaataatgtgctcaattaaaggcataatgattactcaagacaatgttatgttgtctttcttcctccttcctttgcctgcacattgtagcccataatactataccccatcaagtgttcctgctccaagaaatagcttcctcctcttacttgccccagaacatctctgtaaagaatttcctcttatcttcccatatttcagtcaagattcattgctcacgtattacttgtgacctctcttgaccccagccacaataaacttctctatactacccaaaaaatctttccaaaccctcccccacaccattttttatatttttatatttttcttatttatttcatgcacacacacacactccgtgctttataagcaattctgcctattctctaccttcttacatgcctactgtgcctcatattaaattcatcaatgggcagaaagaaaatatttattcaagaaaacagtgaatgaatgaacgaatgagtaaatgagtaaatgaaggaatgattattccttgctttagaacttctggaattagaggacaatattaataataccatcgcacagtgtttctttgttgttaatgctacaacatacaaagaggaagcatgcagtaaacaaccgaacagttatttcctttctgatcataggagtaatatttttttccttgagcaccatttttgccataggtaaaattagaaggatttttagaactttctcagttgtatacatttttaaaaatctgtattatatgcatgttgattaattttaaacttacttgaatacctaaacagaatctgttgtttccttgtgtttgaaagtgctttcacagtaactctgtctgtactgccagaatatactgacaatgtgttatagttaactgttttgatcacaacattttgaattgactggcagcagaagctcttttatatccatgtgttttccttaagtcattatacatagtaggcactgagaactctttatatctgaataagatatttaggaaccactggtttacatatcagaagcagagctactcagggcattttggggaagatcactttcacattcctgagcatagggaagttctcataagagtaagatattaaaaggagatacttgtgtggtattcgaaagacagtaagagagattgtagaccttatgatcttgatagggaaaacaaactacattcctttctccaaaagtcaaaaaaaaagagcaaatatagcttactataccttctattcctacaccattagaagtagtcagtgagtctaggcaagatgttggccctaaaaatccaaataccagagaattcatgagaacatcacctggatgggacatgtgccgagcacacacaattactatatgctaggcattgctatcttcatattgaagatgaggaggtcaagagatgaaaaaagacttggcaccttgttgttatattaaaattatttgttagagtagagcttttgtaagagtctaggagtgtgggagctaaatgatgatacacatggacacaaaaaatagatcaacagacacccaggcctacttgagggttgagggtgggaagagggagacgatgaaaaagaacctattgggtattaagttcatcactgagtgatgaaataatctgtacatcaagacccagtgatatgcaatttacctatataacttgtacatgtacccccaaatttaaaatgaaagttaaaacaaagtataggaatggaattaattcctcaagatttggctttaattttatttgataatttatcaaatggttgtttttcttttctcactatggcgttgctttataaactatgttcagtatgtctgaatgaaagggtgtgtgtgtgtgtgaaagagagggagagaggaagggaagagaggacgtaataatgtgaatttgagttcatgaaaatttttcaataaaataatttaatgtcaggagaattaagcctaatagtctcctaaatcatccatctcttgagcttcagagcagtcctctgaattaatgcctacatgtttgtaaagggtgttcagactgaagccaagattctacctctaaagagatgcaatctcaaatttatctgaagactgtacctctgctctccataaattgacaccatggcccacttaatgaggttaaaaaaaagctaattctgaatgaaaatctgagcccagtggaggaaatattaatgaacaaggtgcagactgaaatataaatttttctgtaataattatgcatatactttagcaaagttctgtctatgttgactttattgctttttggtaagaaatacaactttttaaagtgaactaaactatcctatttccaaactattttgtgtgtgtgcggtttgtttctatgggttctggttttcttggagcatttttatttcattttaattaattaattctgagagctgctgagttgtgtttactgagagattgtgtatctgcgagagaagtctgtagcaagtagctagactgtgcttgacctaggaacatatacagtagattgctaaaatgtctcacttggggaattttagactaaacagtagagcatgtataaaaatactctagtcaagtgctgcttttgaaacaaatgataaaaccacactcccatagatgagtgtcatgattttcatggaggaagttaatattcatcctctaagtatacccagactagggccattctgatataaaacattaggacttaagaaagattaatagactggagtaaaggaaatggacctctgtctctctcgctgtctcttttttgaggacttgtgtgtgtgtgtgtgtgtgtgtgtgtgtgtgtgttgtggtcagtggggctggaataaaagtagaatagacctgcacctgctgtggcatccattcacagagtagaagcaagctcacaatagtgaagatgtcagtaagcttgaatagtttttcaggaactttgaatgctgatttagatttgaaactgaggctctgaccataaccaaatttgcactatttattgcttcttgaaacttatttgcctggtatgcctgggcttttgatggtcttagtatagcttgcagccttgtccctgcagggtattatgggtaatagaaagaaaagtctgcgttacactctagtcacactaagtaactaccattggaaaagcaacccctgccttgaagccaggatgatggtatctgcagcagttgccaacacaagagaaggatccatagttcatcatttaaaaaagaaaacaaaatagaaaaaggaaaactatttctgagcataagaagttgtagggtaagtctttaagaaggtgacaatttctgccaatcaggatttcaaagctcttgctttgacaattttggtctttcagaatactataaatataacctatattataatttcataaagtctgtgcattttctttgacccaggatatttgcaaaagacatattcaaacttccgcagaacactttatttcacatatacatgcctcttatatcagggatgtgaaacagggtcttgaaaactgtctaaatctaaaacaatgctaatgcaggtttaaatttaataaaataaaatccaaaatctaacagccaagtcaaatctgcatgttttaacatttaaaatattttaaagacgtcttttcccaggattcaacatgtgaaatcttttctcagggatacacgtgtgcctagatcctcattgctttagttttttacagaggaatgaatataaaaagaaaatacttaaattttatccctcttacctctataatcatacataggcataattttttaacctaggctccagatagccatagaagaaccaaacactttctgcgtgtgtgagaataatcagagtgagattttttcacaagtacctgatgagggttgagacaggtagaaaaagtgagagatctctatttatttagcaataatagagaaagcatttaagagaataaagcaatggaaataagaaatttgtaaatttccttctgataactagaaatagaggatccagtttcttttggttaacctaaattttatttcattttattgttttattttattttattttattttattttgtgtaatcgtagtttcagagtgttagagctgaaaggaagaagtaggagaaacatgcaaagtaaaagtataacactttccttactaaaccgacatgggtttccaggtaggggcaggattcaggatgactgacagggcccttagggaacactgagaccctacgctgacctcataaatgcttgctacctttgctgttttaattacatcttttaatagcaggaagcagaactctgcacttcaaaagtttttcctcacctgaggagttaatttagtacaaggggaaaaagtacagggggatgggagaaaggcgatcacgttgggaagctatagagaaagaagagtaaattttagtaaaggaggtttaaacaaacaaaatataaagagaaataggaacttgaatcaaggaaatgattttaaaacgcagtattcttagtggactagaggaaaaaaataatctgagccaagtagaagaccttttcccctcctacccctactttctaagtcacagaggctttttgttcccccagacactcttgcagattagtccaggcagaaacagttagatgtccccagttaacctcctatttgacaccactgattaccccattgatagtcacactttgggttgtaagtgactttttatttatttgtatttttgactgcattaagaggtctctagttttttatctcttgtttcccaaaacctaataagtaactaatgcacagagcacattgatttgtatttattctatttttagacataatttattagcatgcatgagcaaattaagaaaaacaacaacaaatgaatgcatatatatgtatatgtatgtgtgtatatatacacacatatatatatatattttttcttttcttaccagaaggttttaatccaaataaggagaagatatgcttagaaccgaggtagagttttcatccattctgtcctgtaagtattttgcatattctggagacgcaggaagagatccatctacatatcccaaagctgaattatggtagacaaaactcttccacttttagtgcatcaacttcttatttgtgtaataagaaaattgggaaaacgatcttcaatatgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaaggcggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaataaatttgaatgggttaaagaattaaactaagacctaaaaccataaaaatttttaaagaaatcaaaagaagaaaattctaatattcacgttgcagccgttttttgaatttgatatgagaagcaaaggcaacaaaaggaaaaataaagaagtgaggctacatcaaactaaaaaatttccacacaaaaaacaaaacaatgaacaaatgaaaggtgaaccatgaaatggcatatttgcaaaccaaatatttcttaaatattttggttaatatccaaaatatataagaaacacagatgattcaataacaaacaaaaaattaaaaataggaaaataaaaaaattaaaaagaagaaaatcctgccatttatggcagaattgatgaacctggaggatgtaaaactaagaaaaataagcctgacacaaaaagacaaatactacacaaccttgctcatatgtgaaacataaaaaagtcactctcatggaaacagacagtagaggtatggtttccaggggttgggggtgggagaatcaggaaactattactcaaagggtataaaatttcagttatgtgggatgaataaattctagatatctaatgtacagcatcgtgactgtagttaattgtactgtaagtatatttaaaatttgcaaagagagtagatttttttttttttttagatggagttttgctcttgttgtccaggctggagtgcaatggcaagatcttggctcactgcaacctccgcctcctgggttcaagcaaatctcctgcctcagcctcccgagtagctgggattacaggcatgcgacaccatgcccagctaattttgtatttttagtagagacggggtttctccatgttggtcaggctgatccgcctgcctcggccacccaaagggctgggattacaggcgtgagccaccgggcctggccgagagtagatcttaaaagcatttaccacaagaaaaaggtaactatgtgagataatgggtatgttaattagcttgattgtggtaatcatttcacaaggtatacatatattaaaacatcatgttgtacaccttaaatatatacaatttttatttgtgaatgatacctcaataaagttgaagaataataaaaaagaatagacatcacatgaattaaaaaactaaaaaataaaaaaatgcatcttgatgattagaattgcattcttgatttttcagatacaaatatccatttgactgtttactcttttccaaaacaatacaataaattttagcactttatcttcattttccccttcccaatctataattatatatatatatattttagatattttgtatagttttactccctagattttctagtgttattattaaatagtgaagaaatgtttacacttatgtacaaaatgttttgcatgcttttcttcatttctaacattctctctaagtttattctatttttttctgattatccttaatattatctctttctgctggaaatacattgttacttttggtttatctaaaaatggcttcattttcttcattctaaaatcatgttaaattaataccactcatgtgtaagtaagatagtggaataaatagaaatccaaaaactaaatctcactaaaatataataatgtgatatataaaaatatagcttttaaatttagcttggaaataaaaaacaaacagtaattgaacaactatactttttgaaaagagtaaagtgaaatgcttaactgcatataccacaatcgattacacaattaggtgtgaaggtaaaattcagtcacgaaaaaactagaataaaaatatgggaagacatgtatataatcttagagataacactgttatttaattatcaacccaaagtagaaactatcaagggagaaataaattcagtcaacaataaaagcatttaagaagttattctaggctgggagcggtggctcacacctgcaattgcagcactttgggaggcctagacaggcggatcacgacgtcaggagttcaagatcagcctggccaacatagtgaaacctcatcgctactaaaaatataaaaacttagcctggcgtggtggcaggcatgtgtaatcccagcaatttgggaggctgaggcaggagaatcgcttgatcctgggaggcagaggttgcagtgagccaagattgtgccactgcattccagcccaggtgacagcatgagactccgtcacaaaaaaaaaagaaaaaaaaaaggggggggggagcggtggagccaagatgaccgaataggaacagctccagtctatagctcccatcgtgagtgacgcagaagacgggtgatttctgcatttccaactgaggtaccaggttcatctcacagggaagtgccaggcagtgggtgcaggacagtaggtgcagtgcactgtgcatgagccaaagcagggcgaggcatcacctcacccgggaagcacaaggggtcagggaattccctttcctagtcaaagaaaagggtgacagatggcacctggaaaatcgggtcactcccgccctaatactgcgctcttccaacaagcttaacaaatggcacaccaggagattatatcccatgcctggctcagagggtcctacgcccatggagcctcgctcattgctagcacagcagtctgaggtcaaactgcaaggtggcagtgaggctgggggaggggtgcccaccattgtccaggcttgagcaggtaaacaaagccgcctggaagctcgaactgggtggagcccaccacagctcaaggaggcctgcctgcctctgtaggctccacctctaggggcagggcacagacaaacaaaagacaacaagaacctctgcagacttaaatgtccctgtctgacagctttgaagagagtagtggttctcccagcacatagcttcagatctgagaacaggcagactgcctcctcaagtgggtccctgacccccgagtagcctaactgggaggcatcccccagtaggggcagactgacacctcacatggctggtactcctctaagacaaaacttccagaggaatgatcaggcagcagcatttgcggttcaccaatatccactgttctgcagccaccgctgttgatacccaggaaaacagcttctggagtggacctccagtaaactccaacagacctgcagctgagggtcctgactgttagaaggaaaactaacaaacagaaaggacatccacaccaaaaacccatctgtacatcgccatcatcaaagaccaaaggtagataaaaccataaagatggggaaaaagcagagcagaaaaactggacactctaaaaatgagagtgcctctcctcctccaaagtaacgcagctcctcaccagcaatggaacaaagctgggcagagaatgactttgacgagttgagagaggaaggcttcagaagatcaaactactccaagctaaaggaggaagttcgaacaaacggcaaagaagtaaaaaactttgaaaaaaaattagatgaatggataactagaataaccaatgcacagaagtccttaaaggacctgatg

SEQ ID NO: 4 - DNA, 25800 bp, Homo sapiens
catcaggtcctttaaggacttctgtgcattggttattctagttatccattcatctaattttttttcaaagttttttacttctttgccgtttgttcgaacttcctcctttagcttggagtagtttgatcttctgaagccttcctctctcaactcgtcaaagtcattctctgcccagctttgttccattgctggtgaggagctgcgttactttggaggaggagaggcactctcatttttagagtgtccagtttttctgctctgctttttccccatctttatggttttatctacctttggtctttgatgatggcgatgtacagatgggtttttggtgtggatgtcctttctgtttgttagttttccttctaacagtcaggaccctcagctgcaggtctgttggagtttactggaggtccactccagaagctgttttcctgggtatcaacagcggtggctgcagaacagtggatattggtgaaccgcaaatgctgctgcctgatcattcctctggaagttttgtcttagaggagtaccagccatgtgaggtgtcagtctgcccctactgggggatgcctcccagttaggctactcgggggtcagggacccacttgaggaggcagtctgcctgttctcagatctgaagctatgtgctgggagaaccactactctcttcaaagctgtcagacagggacatttaagtctgcagaggttcttgttgtcttttgtttgtctgtgccctgcccctagaggtggagcctacagaggcaggcaggcctccttgagctgtggtgggctccacccagttcgagcttccaggcggctttgtttacctgctcaagcctggacaatggtgggcacccctcccccagcctcactgccaccttgcagtttgacctcagactgctgtgctagcaatgagcgaggctccatgggcgtaggaccctctgagccaggcatgggatataatctcctggtgtgccatttgttaagcttgttggaagagcgcagtattagggcgggagtgacccgattttccaggtgccatctgtcacccttttctttgactaggaaagggaattccctgaccccttgtgcttcccgggtgaggtgatgcctcgccctgctttggctcatgcacagtgcactgcacctactgtcctgcacccactgcctggcacttccctgtgagatgaacctggtacctcagttggaaatgcagaaatcacccgtcttctgcgtcactcacgatgggagctatagactggagctgttcctattcggtcatcttggctccaccgctccccccccccttttttttttcttttttttttgtgacggagtctcatgctgtcacctgggctggaatgcagtggcacaatcttggctcactgcaacctctgcctcccaggatcaagcgattctcctgcctcagcctcccaaattgctgggattacacatgcctgccaccacgccaggctaagtttttatatttttagtagcgatgaggtttcactatgttggccaggctgatcttgaactcctgacgtcgtgatccgcctgtctaggcctcccaaagtgctgcaattgcaggtgtgagccaccgctcccagcctagaataacttcttaaatgcttttattgttgactgaatttatttctcccttgatagtttctactttgggttgataattaaataacagtgttatctctaagattatatacatgtcttcccatatttttattctagttttttcgtgactgaattttaccttcacacctaattgtgtaatcgattgtggtatatgcagttaagcatttcactttactcttttcaaaaagtatagttgttcaattactgtttgttttttatttccaagctaaatttaaaagctatatttttatatatcacattattatattttagtgagatttagtttttggatttctatttattccactatcttacttacacatgagtggtattaatttaacatgattttagaatgaagaaaatgaagccatttttagataaaccaaaagtaacaatgtatttccagcagaaagagataatattaaggataatcagaaaaaaatagaataaacttagagagaatgttagaaatgaagaaaagcatgcaaaacattttgtacataagtgtaaacatttcttcactatttaataataacactagaaaatctagggagtaaaactatacaaaatatctaaaatatatatatatataattatagattgggaaggggaaaatgaagataaagtgctaaaatttattgtattgttttggaaaagagtaaacagtcaaatggatatttgtatctgaaaaatcaagaatgcaattctaatcatcaagatgcatttttttattttttagttttttaattcatgtgatgtctattcttttttattattcttcaactttattgaggtatcattcacaaataaaaattgtatatatttaaggtgtacaacatgatgttttaatatatgtataccttgtgaaatgattaccacaatcaagctaattaacatacccattatctcacatagttacctttttcttgtggtaaatgcttttaagatctactctcggccaggcccggtggctcacgcctgtaatcccagccctttgggtggccgaggcaggcggatcagcctgaccaacatggagaaaccccgtctctactaaaaatacaaaattagctgggcatggtgtcgcatgcctgtaatcccagctactcgggaggctgaggcaggagatttgcttgaacccaggaggcggaggttgcagtgagccaagatcttgccattgcactccagcctggacaacaagagcaaaactccatctaaaaaaaaaaaaaaatctactctctttgcaaattttaaatatacttacagtacaattaactacagtcacgatgctgtacattagatatctagaatttattcatcccacataactgaaattttataccctttgagtaatagtttcctgattctcccacccccaacccctggaaaccatacctctactgtctgtttccatgagagtgacttttttatgtttcacatatgagcaaggttgtgtagtatttgtctttttgtgtcaggcttatttttcttagttttacatcctccaggttcatcaattctgccataaatggcaggattttcttctttttaatttttttattttcctatttttaattttttgtttgttattgaatcatctgtgtttcttatatattttggatattaaccaaaatatttaagaaatatttggtttgcaaatatgccatttcatggttcacctttcatttgttcattgttttgttttttgtgtggaaattttttagtttgatgtagcctcacttctttatttttccttttgttgcctttgcttctcatatcaaattcaaaaaacggctgcaacgtgaatattagaattttcttcttttgatttctttaaaaatttttatggttttaggtcttagtttaattctttaacccattcaaatttatttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccgcctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcatatgcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttagtgatacttgtgggccagggcattagccacaccagccaccactttctgataggcagcctgcactggtggggtgaattctttgccaaagtgatgggccagcacacagaccagcacgttgcccaggagctgtgggaggaagataagaggtatgaacatgattagcaaaagggcctagcttggactcagaataatccagccttatcccaaccataaaataaaagcagaatggtagctggattgtagctgctattagcaatatgaaacctcttacatcagttacaatttatatgcagaaatatttatatgcagagatattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtacacatattaaaacattacactttaacccataaatatgtataatgattatgtatcaattaaaaataaaagaaaataaagtagggagattatgaatatgcaaataagcacacatatattccaaatagtaatgtactaggcagactgtgtaaagtttttttttaagttacttaatgtatctcagagatatttccttttgttatacacaatgttaaggcattaagtataatagtaaaaattgcggagaagaaaaaaaaagaaagcaagaattaaacaaaagaaaacaattgttatgaacagcaaataaaagaaactaaaacgatcctgagacttccacactgatgcaatcattcgtctgtttcccattctaaactgtaccctgttacttatccccttcctatgacatgaacttaaccatagaaaagaaggggaaagaaaacatcaagcgtcccatagactcaccctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaacctctgggtccaagggtagaccaccagcagcctaagggtgggaaaatagaccaataggcagagagagtcagtgcctatcagaaacccaagagtcttctctgtctccacatgcccagtttctattggtctccttaaacctgtcttgtaaccttgataccaacctgcccagggcctcaccaccaacttcatccacgttcaccttgccccacagggcagtaacggcagacttctcctcaggagtcagatgcaccatggtgtctgtttgaggttgctagtgaacacagttgtgtcagaagcaaatgtaagcaatagatggctctgccctgacttttatgcccagccctggctcctgccctccctgctcctgggagtagattggccaaccctagggtgtggctccacagggtgaggtctaagtgatgacagccgtacctgtccttggctcttctggcactggcttaggagttggacttcaaaccctcagccctccctctaagatatatctcttggccccataccatcagtacaaattgctactaaaaacatcctcctttgcaagtgtatttacgtaatatttggaatcacagcttggtaagcatattgaagatcgttttcccaattttcttattacacaaataagaagttgatgcactaaaagtggaagagttttgtctaccataattcagctttgggatatgtagatggatctcttcctgcgtctccagaatatgcaaaatacttacaggacagaatggatgaaaactctacctcggttctaagcatatcttctccttatttggattaaaaccttctggtaagaaaagaaaaaatatatatatatatgtgtgtatatatacacacatacatatacatatatatgcattcatttgttgttgtttttcttaatttgctcatgcatgctaataaattatgtctaaaaatagaataaatacaaatcaatgtgctctgtgcattagttacttattaggttttgggaaacaagagataaaaaactagagacctcttaatgcagtcaaaaatacaaataaataaaaagtcacttacaacccaaagtgtgactatcaatggggtaatcagtggtgtcaaataggaggttaactggggacatctaactgtttctgcctggactaatctgcaagagtgtctgggggaacaaaaagcctctgtgacttagaaagtaggggtaggaggggaaaaggtcttctacttggctcagattatttttttcctctagtccactaagaatactgcgttttaaaatcatttccttgattcaagttcctatttctctttatattttgtttgtttaaacctcctttactaaaatttactcttctttctctatagcttcccaacgtgatcgcctttctcccatccccctgtactttttccccttgtactaaattaactcctcaggtgaggaaaaacttttgaagtgcagagttctgcttcctgctattaaaagatgtaattaaaacagcaaaggtagcaagcatttatgaggtcagcgtagggtctcagtgttccctaagggccctgtcagtcatcctgaatcctgcccctacctggaaacccatgtcggtttagtaaggaaagtgttatacttttactttgcatgtttctcctacttcttcctttcagctctaacactctgaaactacgattacacaaaataaaataaaataaaataaaataaaacaataaaatgaaataaaatttaggttaaccaaaagaaactggatcctctatttctagttatcagaaggaaatttacaaatttcttatttccattgctttattctcttaaatgctttctctattattgctaaataaatagagatctctcactttttctacctgtctcaaccctcatcaggtacttgtgaaaaaatctcactctgattattctcacacacgcagaaagtgtttggttcttctatggctatctggagcctaggttaaaaaattatgcctatgtatgattatagaggtaagagggataaaatttaagtattttctttttatattcattcctctgtaaaaaactaaagcaatgaggatctaggcacacgtgtatccctgagaaaagatttcacatgttgaatcctgggaaaagacgtctttaaaatattttaaatgttaaaacatgcagatttgacttggctgttagattttggattttattttattaaatttaaacctgcattagcattgttttagatttagacagttttcaagaccctgtttcacatccctgatataagaggcatgtatatgtgaaataaagtgttctgcggaagtttgaatatgtcttttgcaaatatcctgggtcaaagaaaatgcacagactttatgaaattataatataggttatatttatagtattctgaaagaccaaaattgtcaaagcaagagctttgaaatcctgattggcagaaattgtcaccttcttaaagacttaccctacaacttcttatgctcagaaatagttttcctttttctattttgttttcttttttaaatgatgaactatggatccttctcttgtgttggcaactgctgcagataccatcatcctggcttcaaggcaggggttgcttttccaatggtagttacttagtgtgactagagtgtaacgcagacttttctttctattacccataataccctgcagggacaaggctgcaagctatactaagaccatcaaaagcccaggcataccaggcaaataagtttcaagaagcaataaatagtgcaaatttggttatggtcagagcctcagtttcaaatctaaatcagcattcaaagttcctgaaaaactattcaagcttactgacatcttcactattgtgagcttgcttctactctgtgaatggatgccacagcaggtgcaggtctattctacttttattccagccccactgaccacaacacacacacacacacacacacacacacacacacaagtcctcaaaaaagagacagcgagagagacagaggtccatttcctttactccagtctattaatctttcttaagtcctaatgttttatatcagaatggccctagtctgggtatacttagaggatgaatattaacttcctccatgaaaatcatgacactcatctatgggagtgtggttttatcatttgtttcaaaagcagcacttgactagagtatttttatacatgctctactgtttagtctaaaattccccaagtgagacattttagcaatctactgtatatgttcctaggtcaagcacagtctagctacttgctacagacttctctcgcagatacacaatctctcagtaaacacaactcagcagctctcagaattaattaattaaaatgaaataaaaatgctccaagaaaaccagaacccatagaaacaaaccgcacacacacaaaatagtttggaaataggatagtttagttcactttaaaaagttgtatttcttaccaaaaagcaataaagtcaacatagacagaactttgctaaagtatatgcataattattacagaaaaatttatatttcagtctgcaccttgttcattaatatttcctccactgggctcagattttcattcagaattagcttttttttaacctcattaagtgggccatggtgtcaatttatggagagcagaggtacagtcttcagataaatttgagattgcatctctttagaggtagaatcttggcttcagtctgaacaccctttacaaacatgtaggcattaattcagaggactgctctgaagctcaagagatggatgatttaggagactattaggcttaattctcctgacattaaattattttattgaaaaattttcatgaactcaaattcacattattacgtcctctcttcccttcctctctccctctctttcacacacacacacaccctttcattcagacatactgaacatagtttataaagcaacgccatagtgagaaaagaaaaacaaccatttgataaattatcaaataaaattaaagccaaatcttgaggaattaattccattcctatactttgttttaactttcattttaaatttgggggtacatgtacaagttatataggtaaattgcatatcactgggtcttgatgtacagattatttcatcactcagtgatgaacttaatacccaataggttctttttcatcgtctccctcttcccaccctcaaccctcaagtaggcctgggtgtctgttgatctattttttgtgtccatgtgtatcatcatttagctcccacactcctagactcttacaaaagctctactctaacaaataattttaatataacaacaaggtgccaagtcttttttcatctcttgacctcctcatcttcaatatgaagatagcaatgcctagcatatagtaattgtgtgtgctcggcacatgtcccatccaggtgatgttctcatgaattctctggtatttggatttttagggccaacatcttgcctagactcactgactacttctaatggtgtaggaatagaaggtatagtaagctatatttgctctttttttttgacttttggagaaaggaatgtagtttgttttccctatcaagatcataaggtctacaatctctcttactgtctttcgaataccacacaagtatctccttttaatatcttactcttatgagaacttccctatgctcaggaatgtgaaagtgatcttccccaaaatgccctgagtagctctgcttctgatatgtaaaccagtggttcctaaatatcttattcagatataaagagttctcagtgcctactatgtataatgacttaaggaaaacacatggatataaaagagcttctgctgccagtcaattcaaaatgttgtgatcaaaacagttaactataacacattgtcagtatattctggcagtacagacagagttactgtgaaagcactttcaaacacaaggaaacaacagattctgtttaggtattcaagtaagtttaaaattaatcaacatgcatataatacagatttttaaaaatgtatacaactgagaaagttctaaaaatccttctaattttacctatggcaaaaatggtgctcaaggaaaaaaatattactcctatgatcagaaaggaaataactgttcggttgtttactgcatgcttcctctttgtatgttgtagcattaacaacaaagaaacactgtgcgatggtattattaatattgtcctctaattccagaagttctaaagcaaggaataatcattccttcatttactcatttactcattcgttcattcattcactgttttcttgaataaatattttctttctgcccattgatgaatttaatatgaggcacagtaggcatgtaagaaggtagagaataggcagaattgcttataaagcacggagtgtgtgtgtgtgcatgaaataaataagaaaaatataaaaatataaaaaatggtgtgggggagggtttggaaagattttttgggtagtatagagaagtttattgtggctggggtcaagagaggtcacaagtaatacgtgagcaatgaatcttgactgaaatatgggaagataagaggaaattctttacagagatgttctggggcaagtaagaggaggaagctatttcttggagcaggaacacttgatggggtatagtattatgggctacaatgtgcaggcaaaggaaggaggaagaaagacaacataacattgtcttgagtaatcattatgcctttaattgagcacattattttctcagtaattgttggagtttaatcgtagcattacccttgaggctatgtcttagggttgaggtcttccctagaacctctgcagtgccagtattatctttgtatcaagagttcttgataatttctgctctttggaggtagaagtgtcacccattaatgccttgtacggttcccttgcttttctcttttcccatgtactctttgtaaaataaacaagtgctccctatctgtagagcctcaggaaccttcttacacacctggacaaaaaaatgaaataagtgaaattaatcaggaagttgagctgaacattctttattaggcagaagccatacccttgaagtaggcattgtgttcccaagttcagaaaatagaatctagggaaatagggtcttcttatggttatcaggaaacagtccaggatctcaatggtacttgtgagccagggcattagccacaccagccaccaccttctgataggcagcctgcatttgtggggtgaattccttgccaaagttgcgggccagcacacacaccagcacattgcccaagagctgcggagaagaggtaggcagatacatgcatatggttaacagagaaataaagactggcttctgagaaactgagccaacacccatttttttctgcccaaatcttagacaaaactgatccccaggttattcccatcagcataaataagtacatatatgaatgcatacatataacatatatctatacacacacatcctctatgtacttaactagcatgtagtctatatatgtacatatatgctatatatgctgtataatactatatacaaattaattccaaattagttttaattttgtatgtgtatatagcatatacaaattaattactataaacagattaatagatacaaattaattgattaatcagtgtgatgatgggctgtctcctagcaacgacttctgccccacctccagtgtaactgcctagtctttcataatcaaatattcactttcctttccattccatttactacagaatttataaaattccaattattccttattgtaaaatgatttatagcctctaaaacagtattctatgcctctcatctttgagttggagcctctcccatacccatgtggagagacaaaaggattattctaagtgcagaattagcaggtgagagctggtatgcataatttgagttgttgttagagaaggaaaaatgaagggagggggttgggagagaaagacaggatattaaataatttaaaatagcaagattgtgaggaaggaaaaaatgcagaatatttaaataaaaaattaacaaaattttagaagcattaaatgataaaatatagtaaaatgacaaaaatgtgggagaagagcaggtaggtaaaagaaccaaaatgtaagattagaaagtaaaaagagaaaagtgaagcatctcctggactcaccctgaagttctcaggatccacgtgcagcttgtcacagtgcagctcactcagctgagaaaaagtgcccttgaggttgtccaggtgagccaggccatcactaaaggcacctagcaccttcttgccatgagccttcaccttagggttgcccataacagcatcaggagaggacagatccccaaaggactcaaagaacctctgggtccaagggtagaccaccagtaatctgagggtaggaaaacagcccaagggacagagagtcagtgcctatcagaaacccaagagtcttctctgtctacacatgcccagtttccatttgcctccttgagcctctcttataaccttgataccaacctgcccagggcctcaccaccaactgcatccacgttcactttgccccacagggcattgacagcagtcttctcctcaggagtcagatgcaccatggtgtctgtttgaggttgctagtgaacactgttatgtcagaagaaagtgtaagcaacagtcgactctgccctgccttttatgctggtcctgtcctccctgctccagtgagcaggttggtttaagataagcagggtttcattagtttgtgagaatgaaaaatgaaccttcattccactattcccttaacttgccctgagattggctgttctgtcatgtgtgtcttgactcagaaaccctgttctcctctacatatctccccaccgcatctctttcagcagttgtttctaaaaatatcctcctagtttcatttttgcagaagtgttttaggctaatatagtggaatgtatcttagagtttaacttatttgtttctgtcactttatactaagaaaacttatctaaaagcagatgttttaacaagttgactcaatataaagttcttctttgcctctagagatttttgtctccaagggaattttgagaggttggaatggacaaatctattgctgcagtttaaacttgcttgcttcctccttcttttggtaaattcttcctataataaaactctaattttttattatattgaaataaatatccattaaaagaatatttaaaaaatgaatagtgtttatttaccagttattgaaataggttctggaaacatgaattttaaggttaacattttaatgacagataaaatcaaatattatatacaaatattttgaatgtttaaaattatggtatgactaaagaaagaatgcaaagtgaaaagtagatttaccatattcagccagattaaatttaacgaagttcctgggaatatgctagtacagaacatttttacagatgtgttcttaaaaaaaaatgtggaattagacccaggaatgaagatcccagtagtttttcactcttttctgaattcaaataatgccacaatggcagacaaatacacacccatgagcatatccaaaaggaaggattgaaggaaagaggaggaagaaatggagaaaggaaggaaggaagaggggaagagagaggatggaagggatggaggagaagaaggaaaaataaataatggagaggagaggagaaaaaaggaggggagaggagaggagaagggatagggaagagaaagagaaagggaagggaagagaggaaagaagagaagaggagagaaaagaaacgaagagaggggaagggaaggaaaaaaaagaggaaaaaagagacaagagaagagataagactgacagttcaaattttggtggtgatatggatcaatagaaactcaaactctgttggtgacactgtacaatagtataacccctttggaaaacctttaatagtatccacaaatgctggatgcttgataagtctattacctagcaattacatttttagatattcagaaacacatgcatgtgtgtatccaaagacatgtatagaaatgcttatgacagcaataatcataaaaacctcaaaccggtagccacttaaatgcttaccaacagtagaattgataaattacggtatagtcaaagaatagaatattacacagaaatgaaaagaatcaactactgcttaacacgtagcgatacaaatgcattttacagcatttggttgattaaaagtaaccagaggtgagttcaaactatatgactttatttgtatatagaaagatggatgatgtgcctgagattctgatcacaaggggaaatgttataaaatagggtagagaggagccatgaatgacctttaaactttgttacaagttatttttctgtaacctggaagccaacgaaagatattgaataattcaagaaaggtggtggcatggtttgatttgtgtctttaaaagattattctcacttagtgaagaaatgtattttagaagtagagaaaatgggagacaaatagctgggcttctgttgcagtagggaagaaagtgacaatgccatttctattatcagacttggaccatgacggtgatgtcagtcgtgaacacaagaatagggccacatttgtgagtttagtggtacgataaaatcagaaatacagtcttggatacattgtattgtatgcactcttgtaaaatgcaaaaagatgtacttagatatgtggatctggagctcagaaagaatacaaccaggtcaagaatacagaatggaacagaacatacaagaacagatcataatgtgctgtgtgaatcactaccactacctgttaaaaatgacagatgatgtacttcatcaatatctccttaaaatcttagaatgtgtttgtgagggaggaattatgtttccaattcatatataagaaaattgattctaaaaaaaatgttaggtaaattcttaaggccatgaggactgttatttgatctttgtctgttaattccaaagacttggcttttcactttaattctgttctacctgaaatgattttacacattgggagatctggttacatgtttattctatatggattgcattgagaggatttgtataacagaataaggtctttttttcttttctcttctgagatggagtttcatccctattgcccaagctagagtgcaatggtgcaatctaggctcaccgcaacctctgcctcctgggttcaagcaattctcctgcctcagccacctgaatagctgggactgcaggcatgcaccacacgcccggctgattttgtatttttagtagagatggggtttcaccatgttggtcaggctggtcttgaactcctgacctcaagtgatctgcctgccttggcctcccaaagtgctgggtttacaagcctgagccaccgcatccagccaggataaggtctaaaagtggaaagaatagcatctactcttgttcaggaaacaatgaggacctgactgggcagtaagagtggtgattaatagatagggacaaattgaagcagaatcgaactgttgattagaggtagggaaatgattttaatctgtgaccttggtgaatgggcaagtagctatctaatgactaaaatggaaaacactggaagagaaacagttttagtataacaagtgaaatacccatgctgagtctgaggtgcctataggacatctatataaataagcccagtacattgtttgatatatgggtttggcactgaggttggaggtcagaggttagaaatcagagttgggaattgggattatacaggctgtatttaagagtttagatataactgtgaatccaagagtgtgatgaatacaaagttaaatgaaggacctttaatgaacaccaacatttaatgtgaaatctcaaggaagtatgaagtaagacatagtccccaaaatccccgatgattttagaactcagtatcgattttaattagtgtaatgccaatgtgggttagaatggaagtcaacttgctgttggtttcagagcaggtaggagataaggttctagattttgacacagtgaaaagctgaaacaaaaaggaaaaggtagggtgaaagatgggaaatgtatgtaaggaggatgagccacatggtatgggaggtatactaaggactctagggtcagagaaatatgggttatatccttctacaaaattcacattcttggctgggtgtggtggctcacgcctgtgatcccagcactttcagaggccgaggagggtggatcacctgatgttaggagttcgagatcagcctgaccaacatggtgaaaccccctatctactaaaaatagaaaattagccaggcatggtggtggcacatgcctgtagtgccagctacttgggaggctgaggcaggagaatcgcttgaacctgggaggcagatgttgcagtgagcctggatcatgccattgcactccagcctgggcaaccatagcaatgctctatctcagaaaaaaaaaaaaaaagttcttgctaacctgaaaaaataaattatttgagctttgtacctaattcataattttcagataatgaatattgagatgatatatgcacagaacaatgcctagagacacattctaagtgtgacattcttaaatgccagtgctctccacaattctaatctcagttcactgctgtttgaattctgtgttttcatattatcttatcaatacattaatcattgcaataatcactgcacactgtaattattcatttactggacacatcctagtttccttctgtcaattaccattcatgtctgctttcacatttatttctcatccttccctcagtgttctctgtatttgaggaactgacatttcccaggtttcctcaccctttcagtcgcatgtacattctgcaatggtaaacactggctgagggaaagcataagcaagattatttctggtctctctctctctctgaacggatctcctacagcagacagtcttttttatggttttttatggctgatactttgatgcccccattagacagttctggctctctccaaggagcacccactagctcactgaatccagtggacctctggttatgggctctggttctggactctggtggtataaacattttctccttctgcccttctaggcctaatggcggaagaggttttctgatgttactaacatctagatttctgcactgtcctttatttgatattttagctcttccaatacaaggataattaactattaagagctgtatttaattctaggttgagtaactgataatggtttgtcctttccttgatggaccctaactgatataactaataaactgacttctgatactatgtcttattagtgtatgaaattctgatgtgaataaatgcatgacacatgcttgttgactaatcaaactatagcagaggcagaggaaggaacctcatgacctataaatactaagatatcacatagtcattttagaaccaaaggttcctcagtttaggtctcaaacaaacttctctatggatagtgtaatactcataatgtagaaaagagagatctaattttggataatttaatcttttttttcatctccaaatactagggaaataagagtttacaagacaatgtctctaccataaaagaggttaaaatttagtggtaggaatatacaatgagcagattaagtacattagtaggaaaaacactaaatattataagaaagagcccataattgtagcagagtttatagacagggctttaagcccagttaaaattaaaaaaaaatagcttcttagttgagataacatataagttaggacttaaagtatgagtacaagatagacaaggcaaaatgagggaaagacatcacccagagtaaatgaacagcatgtacaaagctaacagagtcaaatgcagaaatccaaattctctagattgactggggtaattttgtcaatgcactcaagtatgcatctgtaacagtgtgtgttcttatgtgtgcatggaatgtttgttcatggagcataagaaattgtgtagacatatagacacatctgtatgtgtatatcagagaatgtttacattgctacaagattttatatgactacatgcacaagcattcatgctacatgtcagtttggtatatttttcctgtaagatgtgtacttatgtgttttccactaaaggtgaatgtgaaaactcctcatcgagaaatgaacaataagtaacacaggaaattcaaccctcatctcttcatttaaaatacagagtgacattcagaagggcaagggatagcacaagtgtgagattttaaagtgtgattgtttggacacagtaattattcaaagaatgtgcttaattaatgtatgctacaagacagcagttgagtgattattgtacatgagcaactggtatttattctgctttgtgggttattagtggggactcaaaaatatgacaaaggaatttcagaagctgttagatggtagcaccgcctatctatgtgctcccactcaagagatatggtgaggtgagctctttggggtggacacatagaggaaatactttgagaaagaggttttgggattaatgaaactggagaagaaagggtattatatcttctaaaacctctttctttgaggttttaggtttgagggtgctacatacttcctaagggtcttgggtacaggagtttgaagtgattgccacagaatggctacgttcattgccagatccaaacagggggcttgtaggcatttgctgttctgtcaataaatttccttcttttcattcacagacagggattttagctgtcatctctgactctctgtttcacaatgttttccagttctgtgcaatcactgccacaatggtctcttactcgattttttttcttaacttcattgtttccatcaacttcagttctttatccatcacctcaatataattacagcaagctcctctgactatacccaagttagactttgtctaatcagttctatatatatatatacatgtgaatcaattttctacgtttccctatttattatgtcactctcatatgcaagaaacttcagtgatttttgctcaaaacgatagctatttttcttacttcatctggtctctgcatccagtttccctaattttatatcatcctgcctcttttaaatgtccatattctcctctatcaacttgacttaacgtgctgtttcctaaatctcagccttttaatctgctgtttgctcacataaacaaaaatcagtggttttcaatattgattgctaataattttttattcataaaaattgtatatatttatgaatgcacacatgtgtgtgtatatatatagaaagagaataaaatcactaccactaaaaacaataaaacttgtacatatttatagaaacagagagctgaacaaagagatttattatttattgggtagtgtgataaagactttacaggtatcaattcaattagttcttacaaaaatcctttaaggaaaatacatatgataaatctatcatatgcacagcttaatggaattataaatatgtttcaggtcacagaggtagcagatgaagtacagatgaaaaccaagacagccagttcacatgccttagagataattctctattaataccattgaagacgttaagagaaagttcaaggtttggcccttgattggtctctaggaagccccatccccacttcattataaataataaaaaatatgttgtttaaaataagtagaagtgaactgcagtcaccaaatgagctatatcctgagtttcatacaaataatagcctatacagaacttctaatttgagtcctaacatacctctacacactaccaacaatcctcttacacctccaaagagtacctccattgacctccctttctgtaaaaacattgtcttattctagagacgatttccccttcctaggagtaactaccccactaaatccacccacgagttctctcttttcttgcaggattgcaagaaagtatcttctctgtccttaaactcccattctccaacattctcatttccatcagaaatagtgcgtccttttggctgaatcagggtaaaatataaagacagaaaaagagtacaatgatatttcttagagagcatatttctttattctatttttatcatgcaggaactgaatcagcaggcaggatactgctcttctccccaacctcccccatctaaaggagatgagattttgggacataggtacaaacatagtggaccataggtacaaacatagtggacagggaactcagtggtcttgtgggctacagcattaaccacagcatttgttagttactgccaagaagcctgtatctgtagggtaaaatcctcgctgaagtgggttgccaaaacaatcaatatcacgttgcctaagagctggggagggagtgaagataaaaaagaaaatggtacatagtgaatagaaggcctcaagctggacttgcagtaaatagatataacacttacatcctttttcaccagagtttgagcaactctcaccattatgggctagatatcagcttcaatatgactggcagccctgcacctcccattgtgtcctatccttctcttacttgctatgccaactcactaccccaacatattgtgattgtttcattttttttttagagacttcgtccttttaaaaagtaggataatagtacttcaaggaacagtaatggataggataagtccccagtcatcacatacatacatacatacatacatacaattttcccaaacactcataacaaagaatcctgtaccatgcgtacaaaagtataccatcatcattcggagggaaacaatcctctttttaacagcttcccactactttgttcagttgatctttttctaacctccaggactatgcagaaaagtgactattaatttttatagaaaatttcgctgaccaaaggaaagatgttattttctctatctcaacttctgttccctcatccaaaaacactcagtttgattttggccagaattttttataagatgtgtttttcagagctatcaaatggtaagtggccttccattattcatagtccttgctctaccaaattttagttatgttatttacagcaacataactctcaaaatcccactgctgaaatatcatatcccatagctgactcataacacaagagaaagccacctctgctttcaaaagtacccatagtgcaaatatctaagggtaaagaagaaagcgtgagtgtacttactactcaccaggaagttctcagggtccacgtgcagcttgttacagtgcaggtcactcagtgtagcaaaggtgcctttgaggtcatccgtgagcataacagcttttccgaaggagatcagcaccttcttgccatgtgccttgactttggggttgcccattattgcacagtcagagcccagatatccaaaactttcaaagtacctctaggtccatgggtagacaaccaggagactgtgggatagtcataatcacagagcaggtgcaaagtcagactatgtaagacaacgggctaatccctctttcagaaacactttctgcctttctgcaccttgtcccggcttccagtacctacctgcccagaatctcacctccagccttctcaccttaaccttgcttcacaggctggtggcagcagccttcttgtcagcagtgaaatgcactacagtgtcagatctgggagtttcctggtgatcacagatgagccagaagcatgcctgcattgctgcttcatgtgtggctttttacttctcctctctggcccccagccctttgcctctcccagtgaaatgaatctattgaccagccctttgcctccctcagtaaaatgaatctattggtcaagggtgggttgtgactccaggggtggggtttgggcaaggaagttttgcaagatggacattcgagtttctgatagaatccaggtggccttctcaggggaactttgctgttcaggcttaatttgaaactttacttccttcccctccattttcctacactacccccaccatccagtgtgcagtttatttctcaaggacttcgccagcagccgctaataacctgaatgctgacaaataggaataagttacaactgaaaaggataagaattacgaatatcttagccatcaattcctggatcaggagttgtgacaatgtaacaacgtgttatcctgttattcatccaggctttatgtggaagaagccacagcctttcttggttttcaattctcttgagactacattgaatacacaatttcatcagtttttttttctttctttctttctttttcttttttttttttttttttttgagatggagtctcgctttgtcacccaggctggagtgtgcagtggcgcgatctctgctcaccgcaagctctgcctcccaggttcacgccattctcctgcctcagcctcccgagtagctgggactacaggcacccgccactgtctctggctaattttttgtatttttagtagagatggggtttcaccatgttagccaggatggtcttgatctcctgacctcgtgatccgcccacctcagcctcccaaagtgctgggattacaggtgtgagccaccgcgcccggccaatttcatcactttttagaatagaaataaacacctctatccagcatcaacttggaagaaagcagaataagaaacaaactagggaagtaaggggaaaactgggttttattactgtgttttttaatccatttagtagtcagtgtacttatctgaacaaaggagatttcctctgaatcattgaacaatagtccatgtcaaatcctacatatctacaaaattatgccagaacatctaatagtgttgggggagaagtgtgctgctctgttcaagcaagaggataggagattccgtggcccgtgctgggcattaggtcatttgtgtctggcacaggcttgatctatagtctaatgctgtgtttaacttgtctttatatctaatcaggcaaagacattcttcactgacaatattccacaggctgctgcacgtgtctcatgtgctgcacgtctcatgcgtctcaaacaagcaatttcaggaatagacagggcacacttccaccggcagagagaagaacagtttattttatattcttaaggcttactgtcctcatacttagaggttcaggatgctggtttgtgtgttacccctgagataaatccttacaagaaataaagtttaggaaatcacccccatgtgtatttcaaggagactctaaatttcaaagagttaaacccaatatattaaagctgaatttctgatattagagacacaatattttagtctacttgatatagttgagaggcagttacctgttttacttaggaacatggggaaagtttgtagtgacaaacagtttgaggcaaaaccaagattatctttaagagcagagatcgatgatatgaagaaaaagaagtggcaactttgactatatgcaggaaacacatttatattgagttgtggggactggcctcagaggaaacttcaggtcatgtcctttaatggccctaaaactcattcccaaaagaatttctgttcattgccatacctcatatccttaggtacatacatctaaaaccctgcgtaccagtgaacagctgccccatctttccatcagccaaccaggaattcagcagttactgctaacttccacttttctctcacccgctccaggaaaagtgacctgcagtcactttcctggaagtattgattctttcttgtttgtggctgttccccatttccaattgttttccatgattattgcttctactgtgatctatagactcttatatcatcaataccaggttatcattgcagttgtcaacttctctctgttgcatcttatgcattaattcaacaaatacatattagattccatatgtcatccatgaagtttcattcatatgccatccatttttcttaattctgagaatcttacatgaactagacagacagattctctggctaatggtgccctcactatagtgagcagaggagaccagcatacatactaaaagaaatgaattaataagagatttcagatggtattatatgacttgaagaaactgcatattgtacctacaaccatctggtcttttagaaacctgacaaaagcaagcaatggggaaaggattttcaatttaataaatgatgggggagaactggctagccatatgctgaaaaatgaaactggactccttccttataccttatccaaaattaactccagatggattagagacttaaatgaaaaaccccaaactataaaaagcctagaaaaaaatcaaggcaatactattcatgatataaacacgggcacagatttcatgatgaaagcgtgaaaagcaattgcagcaaaagcaaaaattgaccaatggaatctaattaaactaaagagctcctgctcagcaaaagaaactaccatcagagcgaaagacaatctacagaatgggaaaaagattttccaatctattcttctgacaaaggcctaatatccagagtaaacaagaaacttaaacaactttacaagaaaaaaaaaacccattaaaaccatggcacacttttacctataaaacaaacctgcatatcctgtacgtgtacccctgaatttaaggtaacagtaaattaaattaaaagaaaaatgccatggcaatgtcagaaagttaccctatatggcctaaaaagagaaggcataaataatccaaaacttgtttaacatatcatcaaga

SEQ ID NO: 5 - DNA, 25794 bp, Homo sapiens
tccgaataactgtacctccaattattctttaaggtagcatgcaactgtaatagttgcatgtatatatttatcataatactgtaacagaaaacacttactgaatatatactgtgtccctagttctttacacaataaactaatctcatcctcataattctattagctaatacatattatcatcctatatttcagagacttcaagaagttaagcaacttgctcaagatcatctaagaagtaggtggtatttctgggctcatttggcccctcctaatctctcatggcaacatggctgcctaaagtgttgattgccttaattcatcagggatgggctcatactcactgcagaccttaactggcatcctcttttcttatgtgatctgcctgaccctagtagacttatgaaatttctgatgagaaaggagagaggagaaaggcagagctgactgtgatgagtgatgaaggtgccttctcatctgggtaccagtggggcctctaagactaagtcactctgtctcactgtgtcttagccagttccttacagcttgccctgatgggagatagagaatgggtatcctccaacaaaaaaataaattttcatttctcaaggtccaacttatgttttcttaatttttaaaaaaatcttgaccattctccactctctaaaataatccacagtgagagaaacattcttttcccccatcccataaatacctctattaaatatggaaaatctgggcatggtgtctcacacctgtaatcccagcactttgggaggctgaggtgggtggactgcttggagctcaggagttcaagaccatcttggacaacatggtgataccctgcctctacaaaaagtacaaaaattagcctggcatggtggtgtgcacctgtaatcccagctattagggtggctgaggcaggagaattgcttgaacccgggaggcggaggttgcagtgagctgagatcgtgccactgcactccagcctgggggacagagcacattataattaactgttattttttacttggactcttgtggggaataagatacatgttttattcttatttatgattcaagcactgaaaatagtgtttagcatccagcaggtgcttcaaaaccatttgctgaatgattactatactttttacaagctcagctccctctatcccttccagcatcctcatctctgattaaataagcttcagtttttccttagttcctgttacatttctgtgtgtctccattagtgacctcccatagtccaagcatgagcagttctggccaggcccctgtcggggtcagtgccccacccccgccttctggttctgtgtaaccttctaagcaaaccttctggctcaagcacagcaatgctgagtcatgatgagtcatgctgaggcttagggtgtgtgcccagatgttctcagcctagagtgatgactcctatctgggtccccagcaggatgcttacagggcagatggcaaaaaaaaggagaagctgaccacctgactaaaactccacctcaaacggcatcataaagaaaatggatgcctgagacagaatgtgacatattctagaatatattatttcctgaatatatatatatatatacacatatacgtatatatatatatatatatatatttgttgttatcaattgccatagaatgattagttattgtgaatcaaatatttatcttgcaggtggcctctatacctagaagcggcagaatcaggctttattaatacatgtgtatagatttttaggatctatacacatgtattaatatgaaacaaggatatggaagaggaaggcatgaaaacaggaaaagaaaacaaaccttgtttgccattttaaggcacccctggacagctaggtggcaaaaggcctgtgctgttagaggacacatgctcacatacggggtcagatctgacttggggtgctactgggaagctctcatcttaaggatacatctcaggccagtcttggtgcattaggaagatgtaggcaactctgatcctgagaggaaagaaacattcctccaggagagctaaaagggttcacctgtgtgggtaactgtgaaggactacaagaggatgaaaaacaatgacagacagacataatgcttgtgggagaaaaaacaggaggtcaaggggatagagaaggcttccagaagaatggctttgaagctggcttctgtaggagttcacagtggcaaagatgtttcagaaatgtgacatgacttaaggaactatacaaaaaggaacaaatttaaggagaggcagataaattagttcaacagacatgcaaggaattttcagatgaatgttatgtctccactgagcttcttgaggttagcagctgtgagggttttgcaggcccaggacccattacaggacctcacgtatacttgacactgttttttgtattcatttgtgaatgaatgacctcttgtcagtctactcggtttcgctgtgaatgaatgatgtcttgtcagcctacttggtttcgctaagagcacagagagaagatttagtgatgctatgtaaaaacttcctttttggttcaagtgtatgtttgtgatagaaatgaagacaggctacatgatgcatatctaacataaacacaaacattaagaaaggaaatcaacctgaagagtatttatacagataacaaaatacagagagtgagttaaatgtgtaataactgtggcacaggctggaatatgagccatttaaatcacaaattaattagaaaaaaaacagtggggaaaaaattccatggatgggtctagaaagactagcattgttttaggttgagtggcagtgtttaaagggtgatatcagactaaacttgaaatatgtggctaaataactagaatactctttattttttcgtatcatgaatagcagatatagcttgatggccccatgcttggtttaacatccttgctgttcctgacatgaaatccttaatttttgacaaaggggctattcattttcattttatattgggcctagaaattatgtagatggtcctgaggaaaagtttatagcttgtctatttctctctctaacatagttgtcagcacaatgcctaggctataggaagtactcaaagcttgttaaattgaattctatccttcttattcaattctacacatggaggaaaaactcatcagggatggaggcacgcctctaaggaaggcaggtgtggctctgcagtgtgattgggtacttgcaggacgaagggtggggtgggagtggctaaccttccattcctagtgcagaggtcacagcctaaacatcaaattccttgaggtgcggtggctcactcctgtaatcacagcagtttgggacgccaaggtgggcagatcacttgaggtcaggagttggacaccagcccagccaacatagtgaaacctggtctctgcttaaaaatataaaaattagctggacgtggtgacgggagcctgtaatccaactacttgggaggctgaggcaggagaatcgcttgaaccggggaggtggagtttgcactgagcagagatcatgccattgcactccagcctccagagcgagactctgtctaaagaaaaacgaaaacaaacaaacaaacaaacaaacaaaacccatcaaattccctgaccgaacagaattctgtctgattgttctctgacttatctaccattttccctccttaaagaaactgtgaacttccttcagctagaggggcctggctcagaagcctctggtcagcatccaagaaatacttgatgtcactttggctaaaggtatgatgtgtagacaagctccagagatggtttctcatttccatatccacccacccagctttccaattttaaagccaattctgaggtagagactgtgatgaacaaacaccttgacaaaattcaacccaaagactcactttgcctagcttcaaaatccttactctgacatatactcacagccagaaattagcatgcactagagtgtgcatgagtgcaacacacacacacaccaattccatattctctgtcagaaaatcctgttggtttttcgtgaaaggatgttttcagaggctgaccccttgccttcacctccaatgctaccactctggtctaagtcactgtcaccaccacctaaattatagctgttgactcataacaatcttcctgcttctaccactgccccactacaatttcttcccaatatactatccaaattagtcttttcaaaatgtaagtcatatatggtcacctctttgttcaaagtcttctgatagtttcctatatcatttataataaaaccaaatccttacaattctctacaatagttgttcatgcatatattatgtttattacagatacatatatatagctctcatataaataaatatatatatttatgtgtatgtgtgtagagtgttttttcttacaactctatgatgtaggtattattagtgtcccaaattttataatttaggacttctatgatctcatcttttattctccccttcaccgaatctcatcctacattggccttattgatattccttgaaaattctaagcatcttacatctttagggtatttacatttgccattccctatgccctaaatatttaatcatagtttcatataaatgggttcctcatcatctatgggtactctctcaggtgttaactttatagtgaggactttcctgccatactacttaaagtagcgataccctttcaccctgtcctaatcacactctggccttcatttcagttttttttttttctccatagcacctaatctcattggtatataacatgtttcatttgcttatttaatgtcaagctctttccactatcaagtccatgaaaacaggaactttattcctctattctgtttttgtgctgtattcttagcaattttacaattttgaatgaatgaatgagcagtcaaacacatatacaactataattaaaaggatgtatgctgacacatccactgctatgcacacacaaagaaatcagtggagtagagctggaagtgctaagcctgcatagagctagttagccctccgcaggcagagccttgatgggattactgagttctagaattggactcatttgttttgtaggctgagatttgctcttgaaaacttgttctgaccaaaataaaaggctcaaaagatgaatatcgaaaccagggtgttttttacactggaatttataactagagcactcatgtttatgtaagcaattaattgtttcatcagtcaggtaaaagtaaagaaaaactgtgccaaggcaggtagcctaatgcaatatgccactaaagtaaacattatttcataggtgtcagatatggcttattcatccatcttcatgggaaggatggccttggcctggacatcagtgttatgtgaggttcaaaacacctctaggctataaggcaacagagctccttttttttttttctgtgctttcctggctgtccaaatctctaatgataagcatacttctattcaatgagaatattctgtaagattatagttaagaattgtgggagccattccgtctcttatagttaaatttgagcttcttttatgatcactgtttttttaatatgctttaagttctggggtacatgtgccatggtggtttgctgcacccatcaacccgtcatctacattaggtatttctcctaatgctatccttcccctagccccccacccccaacaggccccagtgtgtgatgttcccctccctgtgtccatggatcactggtttttttttgttttttttttttttttaaagtctcagttaaatttttggaatgtaatttattttcctggtatcctaggacttgcaagttatctggtcactttagccctcacgttttgatgataatcacatatttgtaaacacaacacacacacacacacacacacacatatatatatatataaaacatatatatacataaacacacataacatatttatcgggcatttctgagcaactaatcatgcaggactctcaaacactaacctatagccttttctatgtatctacttgtgtagaaaccaagcgtggggactgagaaggcaatagcaggagcattctgactctcactgcctttagctaggcccctccctcatcacagctcagcatagtcctgagctcttatctatatccacacacagtttctgacgctgcccagctatcaccatcccaagtctaaagaaaaaaataatgggtttgcccatctctgttgattagaaaacaaaacaaaataaaataagcccctaagctcccagaaaacatgactaaaccagcaagaagaagaaaatacaataggtatatgaggagactggtgacactagtgtctgaatgaggcttgagtacagaaaagaggctctagcagcatagtggtttagaggagatgtttctttccttcacagatgccttagcctcaataagcttgcggttgtggaagtttactttcagaacaaactcctgtggggctagaattattgatggctaaaagaagcccgggggagggaaaaatcattcagcatcctcacccttagtgacacaaaacagagggggcctggttttccatatttcctcatgatggatgatctcgttaatgaaggtggtctgacgagatcattgcttcttccatttaagccttgctcacttgccaatcctcagttttaaccttctccagagaaatacacattttttattcaggaaacatactatgttatagtttcaatactaaataatcaaagtactgaagatagcatgcataggcaagaaaaagtccttagctttatgttgctgttgtttcagaatttaaaaaagatcaccaagtcaaggacttctcagttctagcactagaggtggaatcttagcatataatcagaggtttttcaaaatttctagacataagattcaaagccctgcacttaaaatagtctcatttgaattaactctttatataaattgaaagcacattctgaactacttcagagtattgttttatttctatgttcttagttcataaatacattaggcaatgcaatttaattaaaaaaacccaagaatttcttagaattttaatcatgaaaataaatgaaggcatctttacttactcaaggtcccaaaaggtcaaagaaaccaggaaagtaaagctatatttcagcggaaaatgggatatttatgagttttctaagttgacagactcaagttttaaccttcagtgcccatcatgtaggaaagtgtggcataactggctgattctggctttctactcctttttcccattaaagatccctcctgcttaattaacattcacaagtaactctggttgtactttaggcacagtggctcccgaggtcagtcacacaataggatgtctgtgctccaagttgccagagagagagattactcttgagaatgagcctcagccctggctcaaactcacctgcaaacttcgtgagagatgaggcagaggtacactacgaaagcaacagttagaagctaaatgatgagaacacatggactcatagagggaaacaacgcatactggggcctatcagagggtggagggtgagagaaggagaggatcaggaaaaatcactaatggatgctaagcgtaatacctgagtgatgagatcatctatacaacaaacccccttgacattcatttatctatgtaacaaacctgcacatcctgtacatgtacccctgaacttaaaataaaagttgaaaacaagaaagcaacagtttgaacacttgttatggtctattctctcattctttacaattacactagaaaatagccacaggcttcctgcaaggcagccacagaatttatgacttgtgatatccaagtcattcctggataatgcaaaatctaacacaaaatctagtagaatcatttgcttacatctatttttgttctgagaatatagatttagatacataatggaagcagaataatttaaaatctggctaatttagaatcctaagcagctcttttcctatcagtggtttacaagccttgtttatatttttcctattttaaaaataaaaataaagtaagttatttgtggtaaagaatattcattaaagtatttatttcttagataataccatgaaaaacattcagtgaagtgaagggcctactttacttaacaagaatctaatttatataatttttcatactaatagcatctaagaacagtacaatatttgactcttcaggttaaacatatgtcataaattagccagaaagatttaagaaaatattggatgtttccttgtttaaattaggcatcttacagtttttagaatcctgcatagaacttaagaaattacaaatgctaaagcaaacccaaacaggcaggaattaatcttcatcgaatttgggtgtttctttctaaaagtcctttatacttaaatgtcttaagacatacatagattttattttactaattttaattatatagacaataaatgaatattcttactgattactttttctgactgtctaatctttctgatctatcctggatggccataacacttatctctctgaactttgggcttttaatataggaaagaaaagcaataatccatttttcatggtatctcatatgataaacaaataaaatgcttaaaaatgagcaggtgaagcaatttatcttgaaccaacaagcatcgaagcaataatgagactgcccgcagcctacctgacttctgagtcaggatttataagccttgttactgagacacaaacctgggcctttcaatgctataacctttcttgaagctcctccctaccacctttagccataaggaaacatggaatgggtcagatccctggatgcaagccaggtctggaaccataggcagtaaggagagaagaaaatgtgggctctgcaactggctccgagggagcaggagaggatcaaccccatactctgaatctaagagaagactggtgtccatactctgaatgggaagaatgatgggattacccatagggcttgttttagggagaaacctgttctccaaactcttggccttgagatacctggtccttattccttggactttggcaatgtctgaccctcacattcaagttctgaggaagggccactgccttcatactgtggatctgtagcaaattccccctgaaaacccagagctgtatcttaattggttaaaaaaaattatattatctcaacgactgttcttctctgagtagccaagctcagcttggttcaagctacaagcagctgagctgctttttgtctagtcattgttcttttatttcagtggatcaaatacgttctttccaaacctaggatcttgtcttcctaggctatatattttgtcccaggaagtcttaatctggggtccacagaacactagggggctggtgaagtttatagaaaaaaaatctgtatttttacttacatgtaactgaaatttagcattttcttctactttgaatgcaaaggacaaactagaatgacatcatcagtacctattgcatagttataaagagaaaccacagatattttcatactacaccataggtattgcagatctttttgtttttgtttttgtttgagatggagtttcgctcttattgcccaggctggagtgcagtggcatgatttcggctcactgcaacctccccttcctgcattcaagcaattctcctgccttggcctcctgagtagctggggattacaggcacctgccaccatgccagtctaatttttgtatttttagtagagatggggtttcgccatgttggccaggctggtcttgaactcctgacctcagatgatctgcccgccttggcctcctgaagtgctgggattataggtgtgagccaccacgcctggcccattgcagatatttttaattcacatttatctgcatcactacttggatcttaaggtagctgtagacccaatcctagatctaatgctttcataaagaagcaaatataataaatactataccacaaatgtaatgtttgatgtctgataatgatatttcagtgtaattaaacttagcactcctatgtatattatttgatgcaataaaaacatatttttttagcacttacagtctgccaaactggcctgtgacacaaaaaaagtttaggaattcctggttttgtctgtgttagccaatggttagaatatatgctcagaaagataccattggttaatagctaaaagaaaatggagtagaaattcagtggcctggaataataacaatttgggcagtcattaagtcaggtgaagacttctggaatcatgggagaaaagcaagggagacattcttacttgccacaagtgtttttttttttttttttttttatcacaaacataagaaaatataataaataacaaagtcaggttatagaagagagaaacgctcttagtaaacttggaatatggaatccccaaaggcacttgacttgggagacaggagccatactgctaagtgaaaaagacgaagaacctctagggcctgaacatacaggaaattgtaggaacagaaattcctagatctggtggggcaaggggagccataggagaaagaaatggtagaaatggatggagacggaggcagaggtgggcagatcatgaggtcaagagatcgagaccatcctggcaaacatggtgaaatcccgtctctactaaaaataaaaaaattagctgggcatggtggcatgcgcctgtagtcccagctgctcgggaggctgaggcaggagaatcgtttgaacccaggaggcgaaggttgcagtgagctgagatagtgccattgcactccagtctggcaacagagtgagactccgtctcaaaaaaaaaaaaaaaagaaagaaagaaaagaaaaagaaaaaagaaaaaataaatggatgtagaacaagccagaaggaggaactgggctggggcaatgagattatggtgatgtaagggacttttatagaattaacaatgctggaatttgtggaactctgcttctattattcccccaatcattacttctgtcacattgatagttaaataatttctgtgaatttattccttgattctaaaatatgaggataatgacaatggtattataagggcagattaagtgatatagcatgagcaatattcttcaggcacatggatcgaattgaatacactgtaaatcccaacttccagtttcagctctaccaagtaaagagctagcaagtcatcaaaatggggacatacagaaaaaaaaaaggacactagaggaataatataccctgactcctagcctgattaatatatcgattcacttttttctctgtttgatgacaaattctggctttaaataattttaggattttaggcttctcagctcccttcccagtgagaagtataagcaggacagacaggcaagcaagaagagagccccaggcaatactcacaaagtagccaatgtcccctgtggtcatagagaaatgaaaagagagaggattctctggaagcactggatgtaatcttttctgtctgtcctctctagggaatcaccccaaggtactgtactttgggattaaggctttagtcccactgtggactacttgctattctgttcagtttctagaaggaactatgtacggtttttgtctccctagagaaactaaggtacagaagttttgtttacaatgcactccttaagagagctagaactgggtgagattctgttttaacagctttattttcttttccttggccctgtttttgtcactgtcaccacctttaaggcaaatgttaaatgcgctttggctgaaactttttttcctattttgagatttgctcctttatatgaggctttcttggaaaaggagaatgggagagatggatatcattttggaagatgatgaagagggtaaaaaaggggacaaatggaaatttgtgttgcagatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcaggtaagcattggttctcaatgcatgggaatgaagggtgaatattaccctagcaagttgattgggaaagtcctcaagattttttgcatctctaattttgtatctgatatggtgtcatttcatagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaaggtgagttcaggtgctggtgatgtgattttttggctttatattttgacattaattgaagctcataatcttattggaaagaccaacaaagatctcagaaatcatgggtcgagcttgatgttagaacagcagacttctagtgagcataaccaaaacttacatgattcagaactagtgacagtaaaggactactaacagcctgaattggcttaacttttcaggaaatcttgccagaacttgatgtgtttatcccagagaattgtattatagaattgtagacttgtgaaagaagaatgaaatttggcttttggtagatgaaagtccatttcaaggaaatagaaatgccttattttatgtgggtcatgataattgaggtttagaaagagatttttgcaaaaaaaataaaagatttgctcaaagaaaaataagacacattttctaaaatatgttaaatttcccatcagtattgtgaccaagtgaaggcttgtttccgaatttgttggggattttaaactcccgctgagaactcttgcagcactcacattctacatttacaaaaattagacaattgcttaaagaaaaacagggagagagggaacccaataatactggtaaaatggggaagggggtgagggtgtaggtaggtagaatgttgaatgtagggctcatagaataaaattgaacctaagctcatctgaattttttgggtgggcacaaaccttggaacagtttgaggtcagggttgtctaggaatgtaggtataaagccgtttttgtttgtttgtttgttttttcatcaagttgttttcggaaacttctactcaacatgcctgtgtgttattttgtcttttgcctaacagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagtaatcaaaaattgcaattttatcttctccatcttttactcttgtgttaaaaggaaaaagtgttcatgggctgagggatggagagaaacataggaagaaccaagagcttccttaagaaatgtatgggggcttgtaaaattaatgtggatgttatgggagaattccaggattccaaggaggatgatatgatggagaaaaatctttatcggggtgggaaaatggttaattaagtggacagagactcctaggcagtttttactgcaccggggaaagaaggagctgttagtggtacctgagaaagcagatttgtggtacatgtcacttttcattaaaaacaaaaacaaaacaaaacaaaacttcatagatatccaagatataggctagaattactattttaatttactcttatttacattttgaagtagctagcttgtcacatgttttatgaaattgatttggagataagatgagtgtgtatcaacaatagcctgctctttccatgaaggattccattatttcatgggttagctgaagctaagacacatgatatcattgtgcattatcttctgatagaatgtaacatgcactaaaataaagttagagttaggacctgagtgggaaagtttttggagagtgtgatgaagactttccgtgggagatagaatactaataaaggcttaaattctaaaaccagcaagctagggcttcgtgacttgcatgaaactggctctctggaagtagaagggagagtaagacatacgtagaggactaggaaagaccagatagtacagggcctggctacaaaaatacaagcttttactatgctattgcaatactaaacgataagcattaggatgttaagtgactcaggaaataagattttgggaaaaagtaatctgcttatgtgcacaaaatggattcaagtttgcagataaaataaaatatggatgatgattcaaggggacagatacaatggttcaaacccaagaggagcagtgagtctgtggaatttgaaggatggacaaaggtggggtgagaaagacatagtattcgactgactgtgggagatgagaaggaagaaggaggtgataaatgactgaaagctcccagactggtgaagataacaggaggaaaccatgcactgacctggtgactctcatgtgtgaagggtagagggatattaacagatttactttttaggaagtgctagattggtcagggagttttgaccttcaggtcttgtgtctttcatatcaaggaacctttgcattttccaagttagagtgccatattttggcaaatataactttattagtaattttatagtgctctcacattgatcagactttttcctgtgaattacttttgaatttggctgtatatatccagaatatgggagagagacaaataattattgtagttgcaggctatcaacaatactggtctctctgagccttataacctttcaatatgcccataaacagagtaaacagggattattcatggcactaaatattttcacctagtcagtcaacaaatgggagcaatgtgcattttttgatacatatttttatatatttatggggtacatgtgatacttacatgcctagaacatgtgatgattaagtctagatatttaggatatccattgctttgagcatttatcatttctatgtattgagaaaatttcaaatcctcatttctagccattttgaaatatataataaatagtaattaactatagtcaccctactcaaatatcaaacattatggcttaatccttctatccaactgtgtttgtacctattaaccaacatctcttaaatcccctcccatacacactcacactttttccagcctctgataactatcattctactctctaccaccatgagacccacttttttagctcccacagatgaataaaaacatgtgatatttgactttctgtatctggcttattttattatctatctctttggcataccaagagtttgtttttgttctgcttcagggctttcaattaacataatgacctctggttccatccatgttgctacaaatgacaagatttcattctttttcatggcaaaatagtactgtgcaaaaatacaattttttaatccgttcatctgttgatagacacttaggttgatcccaaaccttaactattgtgaatagtgcttcaataaacatgagtgtaatgtgtccattggatatactgatttcctttcttttggataaataaccactagtgagattgctggattgtatgatagttctgtttttagtttactgagaaatcttcatactgttttccataatggttgtactattttacattcccaccaacagtgtgtaagaaagagttcccttttctccatatcctcacaaggatctgttattttttgtcttttttgttaatagccgttttaactagagtaagtagatatctcattgtagttttgatttgcatttccctgatcattagtgatgttgagaattttttcatatgtttgttggtcatttgtatatctttttctgagaattgtctgttcatgtccttagcctactttttattgggattgtttgttattttcttgataatctatttgtgttcattttagagcctggatattattcttttgtcagatgtatagattgtgaagattttctcccactctgtgggttgtctgtttattctgcagactcttccttttgccatgcaaaagctctttagtttaatttagtcccagatattttctttgtttttatgtatttgcatttgtgttcttggtcatgaaatcctttcctaagccaatgtgtagaagggtttttccgatgttattttctagaattgttacagtttcagggcttagatttaagtccttgatccatcttgagttgatttttgtataaggtgagagatgaagatccagtttcattctcctacatgtagcttgccagctatccccgcaccatttgttgaatagggtgccctttccccactttatgtttttgtttgctttgtcaaagatcagttggatgtaagtatttgagtttatttctgggttctctattctgttccattggtcgatgtgcctatttgtacaccagcatcatgctgttttggtgactatggccttattgtatagtttgaaatgaggtaatgtaatgccttcagatttgttcttttttttagacttgcttgtttattgggctcttttttggttccataagaattttaggattgttttttctagttctgtgaagactaatggtggtattttgatgggaattgcaatgaatttgtaggttgcttctggcattatggccattttcacaatattgattctacccatctatgagaatggcatgtgtttccatttgtttgtgtcttatatgattactttcagccgtgttttgtagttttccttgtagatgtctttcacctccttggttaggtatatattcctaagtttttgttttgttttgttttgttttttgcagctattgtaaaaggggttgagttcttgattttattctcagcttggtcattgctggtatgtaagaaagcaactcattggtgtacgttaattttgtatccagaaactttgctgaattattttatcagttctagggggttttggaggagtctttagagttttctacatacacaatcatatcatcagcaaacagtgacagtttgactttctctttaacaatttggatgtgctttacttgtttctcttgtctgattgctcttgctaggacttccagtaatatgttaaagagaagtggtgagagtgggtatccttgtctcattccagttttcagacagaatgcttttaactttttcccattcaatataatgttggctgtgtgtttaccatagctggcttttattacattgaggtatgtcctttgtaaaccgattttgctgagttttagtcataaagtgatgttgaattttgttgaatgcagtttctgtggctattgagataatcacatgatttttgtttccaattctctttatgttgtgtatcacacttattgacttgcgtatgttaaaccatccgtgcatccctcgcatgaaacccacttgatcatgggttttgatatgctgtcggatgctattagctagtattttgtcaaggatgttggcatctatgttcatcagggatattgatctgtagtgttttttttttttggttatgttctttcccagttttggtattaaggtgatactggcttcatagaatgatttagggaggattctctctttctctatcttgtagaatactgtcaataggattggtatcaattcttctttgaatgtctggtagaattcagctgtgaatctatctggtcctggacttttttgttgttggtaaatttttattatcatttcagtcttgctgcttattactggtctgttcagggtatctaattcttcctgacttaagctagagccctgtatctttccaggaattcgaacgtctcctttaggttttctagtttatgcatgtaaaggtgttcatagtagccttgaataatcttttgtatttctgtggtatcagtaatagtatctcctgttttgtttctaattgagtttatttgcacttctctcctcttttcttggttaatcttgctaatggtctatcagttttatttatcttttcaaagaaccagctttttatttcatttagcttttgtatttttttgcagttgttttaatttcatttagttctcctcttatcttagttattccctttcttttgctgggttttggttctgtttgtttttgtttctctagtttcttgtggtgtgaccttatattgtctgtctgtcctctttcagactctttgacatcgacatttagggctgtgaactttccttttagcaccatctttgctgtatcctagaggttttgataggttgtgtcactattgtcggtcagttcaagtaattttgttgttcttattatactttaagttctgggatacatgtgcagaatgtgcaggtttgttacataggtatagatgtgccatggtggtttgctgcacccatcaacctgtcatctacattaggtatttcttttaatgttatccctctcctaaccccctcaccccccgacaggccctggtgtgtgatgttcccctccctgtgtccatgtgttctcattgttcaactcccacttatgagtgagaacgtgtggtgtttggtttctctgttcctgtgttagtttgctcagaatgatggtttccaccttcatccatgtccctgcaaagacatgaactcatcatttttatggctgcatagtattccatggtgtatatgtgccacattttctttatccattatatcgctgatggccatttgggttggttccaagtctttgctattgtgaatagtgccacaataaacatacgtgtgcacgtgtctttatagtagaatgatttctaattctttgggtatatacccagtaatgggattgctgggtcaaacagtatttctggttctagatccttgaggaatcgccacactgtcttccacaatggttgaactaatttacacacccatcaacagtgtaaaatttttcctattcttccacatcctctccagcaccttttgtttcctgactttttaataattgccattctaactggcatgagatggtatctcattgtggttttgatttgcatttctctaatgaccagtgatgatgagcttcttttcatgtgtttcttggccacataaatgacttctttagagaagcatctgttcatatcctttgtccactttttgatggggtcgttaggttttttcttgtaaatttgttgaagttctttgtagattttggatgttagccctttgtcagatggatagattgcaaaaattttctcccattctgtaggttgcctgttcactctgatgatagtcttttgctgtgcagaagctctttagtttaattagatcccatatgtcaattttggcctttgttgtcattgcttttgatgttttagtcgtgaatttttgcccatgcctatgtcctgaatggtattgcctaggttatcttctaggatttttatggttttaggttgcacatttaagtctttaatccaccttgagttaatttttgtataaggtgtaaggaaggggtacagtttcagttttatgcatattgctagccagtttttccagcaccatttattaaatagggaattctttctccattgcttttgtgatgtttgtcaaagatcagatggtcgtagatgtgtggcattatttctgaggcttctgttctgttccactggtctatatatctgttttggtaccagtaccatgctgtttttgttactgtagccttgtagtatagtttgaagtcaggtagcatcatgcctccagctttgttctttttgtttaggattgtcttggctatatgggctcttttttgattccatatgacatttaaagtagttttttctaattctttgaaaaaagtcagtggtagcttgatggggatagcattgaatctataaattactttgggcagtatggccattttaaagatattgattctttctatctatgagcatggaatgtttttccatttgtttgtgtcctctcttatttccttgagcagtgagtggtttgtagctctccttgaagaggttcttcacatcccttagaagttgtatttctaggtattttattttattctctttgcagcaattgtgaatgggagttcacccatgatttggctctctgcttgtctattattggtgtataggaacgcttgtgatttctgcacactgattttgtatcttgagactttgctgaagctgtttatcagcttaagattttgggctgagatgacagggtcttctaaatatacaatcatgtcatctgcaaacagagacaatttgacttcctctcttcctatttgaatatgctttatttctttctcttgcctgattgtcctggcgagaacttccaatactatgttgagtaagagtggcgagagggcatccttgtcttgtgccggttttcaaagcaaatgatttttaaatttccatcttgatttcattgttgacccaatgatcattcaggagcaggttatttaatttccctgtatttgcatggttttgaaggttccttttgtagttgatttccaattttattctactgtggtctgagagagtgcttgatataatttcaatttttaaaaatttattgaggcttgttttgtggcatatcatatggcctatcttggagaaagttccatgtgctgatgaatagaatgtgtattctgcagttgttgggtagaatgtcctgtaaatatctgttaagtccatttgttctttaaatccattgtttctttgtagactgtcttgatgacctgcctagtgcagtcagtggagtattgaagtcccccactattattatgttgctgtctagtctagtagtaattgttttataaatttgggatctccagtattagatgcatatatattaagaattgtaatattctcccattggacaagggcttttatcattatatgatgtccctctttgtcttttttaactgctgtttctttaaagtttgttttgtctgacataagaatagctgctttggctcgcttttggtgtccatttgtgtggaatgtcattttccacccctttaccttaagtttatgtgagtccttatgtgttaggtgagtctcctgaaggcggcagataactggttggtgaattcttattcattctgcaattctgtatcttttaagtggagcatttagtccatttacattcaacatcagtattgaggtgtgaggtactattccattcttcgtggtatttgttgcctgtgtatctttttatctgtatttttgttgtatatgtcctatgggatttatgctttaaagaggttctgttttgatgtgcttccagggtttatttcaagatttagagctccttttatcagttcttgtagtgttggcttggtagtgccgaattctctcagcatttgtttttctgaaaaacactgtgtattttcttcatttgtgaagcttagtttcactggatataaaattcttggctgataattgttttgtttaagaaggctgaagatagggccatattcacttctagcttttacggtttctgctgagaaatctgctgttaatctgataggttttctttcataggttacctggtagtttcacctcacagctcttaagattctctttgtctttagataactttggatactctgatgacaatgtacctaggcaatgatatttttgcaatgaatttcccaggtgtttattgagcttcttgtatttggatatctaggtctctagcaaggtgggggaagttttccttgattatttccctggataagttttccaaacttttagatttctcttctttctcaggaatgctgattattcttaggtttgattgtttaacataatcccagatttcttggaggctttgttcatattttcttattcttttttctttgtctttgttggattgggttaattcaaaaactttgtcttcaagctctgaatttcttctgcttggattctattgctgagactttctagagcattttgcatttctataagtgcatccattcatccattgtttcctgaagttttgaatgttttttatttatgctatctctttaactgaagatttctcccctcatttcttgtatcatatttttggtttttttaaaattggacttcaccttcctcggatgcctccttgattagcttaataactgaccttctgaattatttttcaggtaaatcagggatttcttcttggtttggatgcattgctggtgagctagtatgattttttggggggtgttaaagaaccttgtttttcatattaccagagttagttttctggttccttctcacttgggtaggctctgtcagagggaaagtctaggcctcaaggctgagacttttgtcccatgaggtgttcccttgatgtagcacagtcccccttttcctaggcgtggggcttcctgagagccgaactgtagtgattgttatctctcttctggatctagccacccatcaggtctaccagactccaggctggtactggggtttgtctgcacagagtcttgtgacgtgaaccatctgtgggtctctcagccatagatacaaccacctgctccaatggaggtggcagaggatgaaatggactctgtgagggtccttacttttggttgttcaatgcactatttttgtgctggttggcctcctgccaggaggtggcactttctagaaagcatcagcagaggcagtcaggtggtggtggctgggggggctggggcaccctagaactcccaagaatatatgccctttgtcttcagctaccagggtgagtaaggaaggaccatcaggtgggggcaggactagtcgtgtctgagctcagagtctccttgggcaggtctttctgtggctactgtgggaggatgggggtgtagtttccaggtcaatggatttatgttcctaggacaattatggctgcctctgctgtgtcatgcaggtcatcaggaaagtgggggaaagcaagcagtcacgtgacttgcccagctcccatgcaactcaaaaggttggtctcacttccagcgtgcaccctcccccgcaacagcaccgaatctgtttccatgcagtcagtgagcaaggctgagaacttgccccaggctaccagctgcgaaaccaagtagggctgtcctacttccctgccagtggagtctgcacaccaaattcatgtccccccaccaacccccccactgcccagcccctagatctggccaggtggagattttctttttcctgtcatcttttcccagttcctctggcagccctcccaaatgacccctgtgaggcaaggcagaaatggcttcctaggggacccagagagcccacagggcttttcccgctgcttcctctacccctgtattttgcttggccctctaaattgactcagctccaggtaaggtcagaatcttctcctgtggtctagatcttcaggttccccagtgaggatgtgtgtttgggggtagacggtcccccttttccacttccacagtttgggcactcacaatatttggggtgtttcccgggtcctgcaggagcaatctgcttctttcagagggtgtgtgcgttctctcagctttcttgatttatttctgcaggtggttctgcaaaaaaaattcctgatgggagacttcacatgctgctctgtgcatccgagtgggagctgcaatgtacttctgctgcctcccatctgccatcaccctctaatttgtcggtaatatgcatttttaatcaatctttttttctctctctctctttttcttctcccccaaaactatactgccctttgatatcaaggaatcaaggacgtgatgttgaggggtgggcagtggatacactctttaccccttagggagctatatctagatttagatattgccaattcaagataacttaattgaaagcaaattcataatgaatacacacacacacacacacatctgcatgacaagatttttaatagttgaaagaataactaataattgtccacaggcaataagggctttttaagcaaaacagttgtgataaacaggtcattcttagaatagtaatccagccaatagtacaggttgcttagagattatgtcattaccagagttaaaattctataatggcttctcactccctaccactgaggacaagtttatgtccttaggtttatgcttccctgaaacaataccacctgctattctccactttacatatcaacggcactggttctttatctaactctctggcacagcaggagtttgttttcttctgcttcagagctttgaatttactatttcagcttctaaactttatttggcaatgccttcccatggcagattccttctgtcattttgcctctgttcgaatactttctccttaatttcattcttagttaataatatctgaaattattttgttgtttaacttaattattaattttatgtatgttctacctagattataatcttcagaggaaagttttattctctgacttatttaacttaaatgcccactactttaaaaattatgacatttatttaacagatatttgctgaacaaatgtttgaaaatacatgggaaagaatgcttgaaaacacttgaaattgcttgtgtaaagaaacagttttatcagttaggatttaatcaatgtcagaagcaatgatataggaaaaatcgaggaataagacagttatggataaggagaaatcaacaaactcttaaaagatattgcctcaaaagcataagaggaaataagggtttatacatgacttttagaacactgccttggtttttggataaatggggaagttgtttgaaaacaggagggatcctagatattccttagtctgaggaggagcaattaagattcacttgtttagaggctgggagtggtggctcacgcctgtaatcccagaattttgggaggccaaggcaggcagatcacctgaggtcaagagttcaagaccaacctggccaacatggtgaaatcccatctctacaaaaatacaaaaattagacaggcatgatggcaagtgcctgtaatcccagctacttgggaggctgaggaaggagaattgcttgaacctggaaggcaggagttgcagtgagccgagatcataccactgcactccagcctgggtgacagaacaagactctgtctcaaaaaaaaaaaagagagattcaaaagattcacttgtttaggccttagcgggcttagacaccagtctctgacacattcttaaaggtcaggctctacaaatggaacccaaccagactctcagatatggccaaagatctatacacacccatctcacagatcccctatcttaaagagaccctaatttgggttcacctcagtctctataatctgtaccagcatacc

SEQ ID NO: 6 - DNA, 25794 bp, Homo sapiens
ggtatgctggtacagattatagagactgaggtgaacccaaattagggtctctttaagataggggatctgtgagatgggtgtgtatagatctttggccatatctgagagtctggttgggttccatttgtagagcctgacctttaagaatgtgtcagagactggtgtctaagcccgctaaggcctaaacaagtgaatcttttgaatctctcttttttttttttgagacagagtcttgttctgtcacccaggctggagtgcagtggtatgatctcggctcactgcaactcctgccttccaggttcaagcaattctccttcctcagcctcccaagtagctgggattacaggcacttgccatcatgcctgtctaatttttgtatttttgtagagatgggatttcaccatgttggccaggttggtcttgaactcttgacctcaggtgatctgcctgccttggcctcccaaaattctgggattacaggcgtgagccaccactcccagcctctaaacaagtgaatcttaattgctcctcctcagactaaggaatatctaggatccctcctgttttcaaacaacttccccatttatccaaaaaccaaggcagtgttctaaaagtcatgtataaacccttatttcctcttatgcttttgaggcaatatcttttaagagtttgttgatttctccttatccataactgtcttattcctcgatttttcctatatcattgcttctgacattgattaaatcctaactgataaaactgtttctttacacaagcaatttcaagtgttttcaagcattctttcccatgtattttcaaacatttgttcagcaaatatctgttaaataaatgtcataatttttaaagtagtgggcatttaagttaaataagtcagagaataaaactttcctctgaagattataatctaggtagaacatacataaaattaataattaagttaaacaacaaaataatttcagatattattaactaagaatgaaattaaggagaaagtattcgaacagaggcaaaatgacagaaggaatctgccatgggaaggcattgccaaataaagtttagaagctgaaatagtaaattcaaagctctgaagcagaagaaaacaaactcctgctgtgccagagagttagataaagaaccagtgccgttgatatgtaaagtggagaatagcaggtggtattgtttcagggaagcataaacctaaggacataaacttgtcctcagtggtagggagtgagaagccattatagaattttaactctggtaatgacataatctctaagcaacctgtactattggctggattactattctaagaatgacctgtttatcacaactgttttgcttaaaaagcccttattgcctgtggacaattattagttattctttcaactattaaaaatcttgtcatgcagatgtgtgtgtgtgtgtgtgtattcattatgaatttgctttcaattaagttatcttgaattggcaatatctaaatctagatatagctccctaaggggtaaagagtgtatccactgcccacccctcaacatcacgtccttgattccttgatatcaaagggcagtatagttttgggggagaagaaaaagagagagagagaaaaaaagattgattaaaaatgcatattaccgacaaattagagggtgatggcagatgggaggcagcagaagtacattgcagctcccactcggatgcacagagcagcatgtgaagtctcccatcaggaattttttttgcagaaccacctgcagaaataaatcaagaaagctgagagaacgcacacaccctctgaaagaagcagattgctcctgcaggacccgggaaacaccccaaatattgtgagtgcccaaactgtggaagtggaaaagggggaccgtctacccccaaacacacatcctcactggggaacctgaagatctagaccacaggagaagattctgaccttacctggagctgagtcaatttagagggccaagcaaaatacaggggtagaggaagcagcgggaaaagccctgtgggctctctgggtcccctaggaagccatttctgccttgcctcacaggggtcatttgggagggctgccagaggaactgggaaaagatgacaggaaaaagaaaatctccacctggccagatctaggggctgggcagtgggggggttggtggggggacatgaatttggtgtgcagactccactggcagggaagtaggacagccctacttggtttcgcagctggtagcctggggcaagttctcagccttgctcactgactgcatggaaacagattcggtgctgttgcgggggagggtgcacgctggaagtgagaccaaccttttgagttgcatgggagctgggcaagtcacgtgactgcttgctttcccccactttcctgatgacctgcatgacacagcagaggcagccataattgtcctaggaacataaatccattgacctggaaactacacccccatcctcccacagtagccacagaaagacctgcccaaggagactctgagctcagacacgactagtcctgcccccacctgatggtccttccttactcaccctggtagctgaagacaaagggcatatattcttgggagttctagggtgccccagcccccccagccaccaccacctgactgcctctgctgatgctttctagaaagtgccacctcctggcaggaggccaaccagcacaaaaatagtgcattgaacaaccaaaagtaaggaccctcacagagtccatttcatcctctgccacctccattggagcaggtggttgtatctatggctgagagacccacagatggttcacgtcacaagactctgtgcagacaaaccccagtaccagcctggagtctggtagacctgatgggtggctagatccagaagagagataacaatcactacagttcggctctcaggaagccccacgcctaggaaaagggggactgtgctacatcaagggaacacctcatgggacaaaagtctcagccttgaggcctagactttccctctgacagagcctacccaagtgagaaggaaccagaaaactaactctggtaatatgaaaaacaaggttctttaacaccccccaaaaaatcatactagctcaccagcaatgcatccaaaccaagaagaaatccctgatttacctgaaaaataattcagaaggtcagttattaagctaatcaaggaggcatccgaggaaggtgaagtccaattttaaaaaaaccaaaaatatgatacaagaaatgaggggagaaatcttcagttaaagagatagcataaataaaaaacattcaaaacttcaggaaacaatggatgaatggatgcacttatagaaatgcaaaatgctctagaaagtctcagcaatagaatccaagcagaagaaattcagagcttgaagacaaagtttttgaattaacccaatccaacaaagacaaagaaaaaagaataagaaaatatgaacaaagcctccaagaaatctgggattatgttaaacaatcaaacctaagaataatcagcattcctgagaaagaagagaaatctaaaagtttggaaaacttatccagggaaataatcaaggaaaacttcccccaccttgctagagacctagatatccaaatacaagaagctcaataaacacctgggaaattcattgcaaaaatatcattgcctaggtacattgtcatcagagtatccaaagttatctaaagacaaagagaatcttaagagctgtgaggtgaaactaccaggtaacctatgaaagaaaacctatcagattaacagcagatttctcagcagaaaccgtaaaagctagaagtgaatatggccctatcttcagccttcttaaacaaaacaattatcagccaagaattttatatccagtgaaactaagcttcacaaatgaagaaaatacacagtgtttttcagaaaaacaaatgctgagagaattcggcactaccaagccaacactacaagaactgataaaaggagctctaaatcttgaaataaaccctggaagcacatcaaaacagaacctctttaaagcataaatcccataggacatatacaacaaaaatacagataaaaagatacacaggcaacaaataccacgaagaatggaatagtacctcacacctcaatactgatgttgaatgtaaatggactaaatgctccacttaaaagatacagaattgcagaatgaataagaattcaccaaccagttatctgccgccttcaggagactcacctaacacataaggactcacataaacttaaggtaaaggggtggaaaatgacattccacacaaatggacaccaaaagcgagccaaagcagctattcttatgtcagacaaaacaaactttaaagaaacagcagttaaaaaagacaaagagggacatcatataatgataaaagcccttgtccaatgggagaatattacaattcttaatatatatgcatctaatactggagatcccaaatttataaaacaattactactagactagacagcaacataataatagtgggggacttcaatactccactgactgcactaggcaggtcatcaagacagtctacaaagaaacaatggatttaaagaacaaatggacttaacagatatttacaggacattctacccaacaactgcagaatacacattctattcatcagcacatggaactttctccaagataggccatatgatatgccacaaaacaagcctcaataaatttttaaaaattgaaattatatcaagcactctctcagaccacagtagaataaaattggaaatcaactacaaaaggaaccttcaaaaccatgcaaatacagggaaattaaataacctgctcctgaatgatcattgggtcaacaatgaaatcaagatggaaatttaaaaatcatttgctttgaaaaccggcacaagacaaggatgccctctcgccactcttactcaacatagtattggaagttctcgccaggacaatcaggcaagagaaagaaataaagcatattcaaataggaagagaggaagtcaaattgtctctgtttgcagatgacatgattgtatatttagaagaccctgtcatctcagcccaaaatcttaagctgataaacagcttcagcaaagtctcaagatacaaaatcagtgtgcagaaatcacaagcgttcctatacaccaataatagacaagcagagagccaaatcatgggtgaactcccattcacaattgctgcaaagagaataaaataaaatacctagaaatacaacttctaagggatgtgaagaacctcttcaaggagagctacaaaccactcactgctcaaggaaataagagaggacacaaacaaatggaaaaacattccatgctcatagatagaaagaatcaatatctttaaaatggccatactgcccaaagtaatttatagattcaatgctatccccatcaagctaccactgacttttttcaaagaattagaaaaaactactttaaatgtcatatggaatcaaaaaagagcccatatagccaagacaatcctaaacaaaaagaacaaagctggaggcatgatgctacctgacttcaaactatactacaaggctacagtaacaaaaacagcatggtactggtaccaaaacagatatatagaccagtggaacagaacagaagcctcagaaataatgccacacatctacgaccatctgatctttgacaaacatcacaaaagcaatggagaaagaattccctatttaataaatggtgctggaaaaactggctagcaatatgcataaaactgaaactgtaccccttccttacaccttatacaaaaattaactcaaggtggattaaagacttaaatgtgcaacctaaaaccataaaaatcctagaagataacctaggcaataccattcaggacataggcatgggcaaaaattcacgactaaaacatcaaaagcaatgacaacaaaggccaaaattgacatatgggatctaattaaactaaagagcttctgcacagcaaaagactatcatcagagtgaacaggcaacctacagaatgggagaaaatttttgcaatctatccatctgacaaagggctaacatccaaaatctacaaagaacttcaacaaatttacaagaaaaaacctaacgaccccatcaaaaagtggacaaaggatatgaacagatgcttctctaaagaagtcatttatgtggccaagaaacacatgaaaagaagctcatcatcactggtcattagagaaatgcaaatcaaaaccacaatgagataccatctcatgccagttagaatggcaattattaaaaagtcaggaaacaaaaggtgctggagaggatgtggaagaataggaaaaattttacactgttgatgggtgtgtaaattagttcaaccattgtggaagacagtgtggcgattcctcaaggatctagaaccagaaatactgtttgacccagcaatcccattactgggtatatacccaaagaattagaaatcattctactataaagacacgtgcacacgtatgtttattgtggcactattcacaatagcaaagacttggaaccaacccaaatggccatcagcgatataatggataaagaaaatgtggcacatatacaccatggaatactatgcagccataaaaatgatgagttcatgtctttgcagggacatggatgaaggtggaaaccatcattctgagcaaactaacacaggaacagagaaaccaaacaccacacgttctcactcataagtgggagttgaacaatgagaacacatggacacagggaggggaacatcacacaccagggcctgtcggggggtgagggggttaggagagggataacattaaaagaaatacctaatgtagatgacaggttgatgggtgcagcaaaccaccatggcacatctatacctatgtaacaaacctgcacattctgcacatgtatcccagaacttaaagtataataagaacaacaaaattacttgaactgaccgacaatagtgacacaacctatcaaaacctctaggatacagcaaagatggtgctaaaaggaaagttcacagccctaaatgtcgatgtcaaagagtctgaaagaggacagacagacaatataaggtcacaccacaagaaactagagaaacaaaaacaaacagaaccaaaacccagcaaaagaaagggaataactaagataagaggagaactaaatgaaattaaaacaactgcaaaaaaatacaaaagctaaatgaaataaaaagctggttctttgaaaagataaataaaactgatagaccattagcaagattaaccaagaaaagaggagagaagtgcaaataaactcaattagaaacaaaacaggagatactattactgataccacagaaatacaaaagattattcaaggctactatgaacacctttacatgcataaactagaaaacctaaaggagacgttcgaattcctggaaagatacagggctctagcttaagtcaggaagaattagataccctgaacagaccagtaataagcagcaagactgaaatgataataaaaatttaccaacaacaaaaaagtccaggaccagatagattcacagctgaattctaccagacattcaaagaagaattgataccaatcctattgacagtattctacaagatagagaaagagagaatcctccctaaatcattctatgaagccagtatcaccttaataccaaaactgggaaagaacataaccaaaaaaaaaaaacactacagatcaatatccctgatgaacatagatgccaacatccttgacaaaatactagctaatagcatccgacagcatatcaaaacccatgatcaagtgggtttcatgcgagggatgcacggatggtttaacatacgcaagtcaataagtgtgatacacaacataaagagaattggaaacaaaaatcatgtgattatctcaatagccacagaaactgcattcaacaaaattcaacatcactttatgactaaaactcagcaaaatcggtttacaaaggacatacctcaatgtaataaaagccagctatggtaaacacacagccaacattatattgaatgggaaaaagttaaaagcattctgtctgaaaactggaatgagacaaggatacccactctcaccacttctctttaacatattactggaagtcctagcaagagcaatcagacaagagaaacaagtaaagcacatccaaattgttaaagagaaagtcaaactgtcactgtttgctgatgatatgattgtgtatgtagaaaactctaaagactcctccaaaaccccctagaactgataaaataattcagcaaagtttctggatacaaaattaacgtacaccaatgagttgctttcttacataccagcaatgaccaagctgagaataaaatcaagaactcaaccccttttacaatagctgcaaaaaacaaaacaaaacaaaacaaaaacttaggaatatatacctaaccaaggaggtgaaagacatctacaaggaaaactacaaaacacggctgaaagtaatcatataagacacaaacaaatggaaacacatgccattctcatagatgggtagaatcaatattgtgaaaatggccataatgccagaagcaacctacaaattcattgcaattcccatcaaaataccaccattagtcttcacagaactagaaaaaacaatcctaaaattcttatggaaccaaaaaagagcccaataaacaagcaagtctaaaaaaaagaacaaatctgaaggcattacattacctcatttcaaactatacaataaggccatagtcaccaaaacagcatgatgctggtgtacaaataggcacatcgaccaatggaacagaatagagaacccagaaataaactcaaatacttacatccaactgatctttgacaaagcaaacaaaaacataaagtggggaaagggcaccctattcaacaaatggtgcggggatagctggcaagctacatgtaggagaatgaaactggatcttcatctctcaccttatacaaaaatcaactcaagatggatcaaggacttaaatctaagccctgaaactgtaacaattctagaaaataacatcggaaaaacccttctacacattggcttaggaaaggatttcatgaccaagaacacaaatgcaaatacataaaaacaaagaaaatatctgggactaaattaaactaaagagcttttgcatggcaaaaggaagagtctgcagaataaacagacaacccacagagtgggagaaaatcttcacaatctatacatctgacaaaagaataatatccaggctctaaaatgaacacaaatagattatcaagaaaataacaaacaatcccaataaaaagtaggctaaggacatgaacagacaattctcagaaaaagatatacaaatgaccaacaaacatatgaaaaaattctcaacatcactaatgatcagggaaatgcaaatcaaaactacaatgagatatctacttactctagttaaaacggctattaacaaaaaagacaaaaaataacagatccttgtgaggatatggagaaaagggaactctttcttacacactgttggtgggaatgtaaaatagtacaaccattatggaaaacagtatgaagatttctcagtaaactaaaaacagaactatcatacaatccagcaatctcactagtggttatttatccaaaagaaaggaaatcagtatatccaatggacacattacactcatgtttattgaagcactattcacaatagttaaggtttgggatcaacctaagtgtctatcaacagatgaacggattaaaaaattgtatttttgcacagtactattttgccatgaaaaagaatgaaatcttgtcatttgtagcaacatggatggaaccagaggtcattatgttaattgaaagccctgaagcagaacaaaaacaaactcttggtatgccaaagagatagataataaaataagccagatacagaaagtcaaatatcacatgtttttattcatctgtgggagctaaaaaagtgggtctcatggtggtagagagtagaatgatagttatcagaggctggaaaaagtgtgagtgtgtatgggaggggatttaagagatgttggttaataggtacaaacacagttggatagaaggattaagccataatgtttgatatttgagtagggtgactatagttaattactatttattatatatttcaaaatggctagaaatgaggatttgaaattttctcaatacatagaaatgataaatgctcaaagcaatggatatcctaaatatctagacttaatcatcacatgttctaggcatgtaagtatcacatgtaccccataaatatataaaaatatgtatcaaaaaatgcacattgctcccatttgttgactgactaggtgaaaatatttagtgccatgaataatccctgtttactctgtttatgggcatattgaaaggttataaggctcagagagaccagtattgttgatagcctgcaactacaataattatttgtctctctcccatattctggatatatacagccaaattcaaaagtaattcacaggaaaaagtctgatcaatgtgagagcactataaaattactaataaagttatatttgccaaaatatggcactctaacttggaaaatgcaaaggttccttgatatgaaagacacaagacctgaaggtcaaaactccctgaccaatctagcacttcctaaaaagtaaatctgttaatatccctctacccttcacacatgagagtcaccaggtcagtgcatggtttcctcctgttatcttcaccagtctgggagctttcagtcatttatcacctccttcttccttctcatctcccacagtcagtcgaatactatgtctttctcaccccacctttgtccatccttcaaattccacagactcactgctcctcttgggtttgaaccattgtatctgtccccttgaatcatcatccatattttattttatctgcaaacttgaatccattttgtgcacataagcagattactttttcccaaaatcttatttcctgagtcacttaacatcctaatgcttatcgtttagtattgcaatagcatagtaaaagcttgtatttttgtagccaggccctgtactatctggtctttcctagtcctctacgtatgtcttactctcccttctacttccagagagccagtttcatgcaagtcacgaagccctagcttgctggttttagaatttaagcctttattagtattctatctcccacggaaagtcttcatcacactctccaaaaactttcccactcaggtcctaactctaactttattttagtgcatgttacattctatcagaagataatgcacaatgatatcatgtgtcttagcttcagctaacccatgaaataatggaatccttcatggaaagagcaggctattgttgatacacactcatcttatctccaaatcaatttcataaaacatgtgacaagctagctacttcaaaatgtaaataagagtaaattaaaatagtaattctagcctatatcttggatatctatgaagttttgttttgttttgtttttgtttttaatgaaaagtgacatgtaccacaaatctgctttctcaggtaccactaacagctccttctttccccggtgcagtaaaaactgcctaggagtctctgtccacttaattaaccattttcccaccccgataaagatttttctccatcatatcatcctccttggaatcctggaattctcccataacatccacattaattttacaagcccccatacatttcttaaggaagctcttggttcttcctatgtttctctccatccctcagcccatgaacactttttccttttaacacaagagtaaaagatggagaagataaaattgcaatttttgattactgaagaaaatgtactttattaaacagaaggctttctctcaaggccaagcccagtccccatgtgcagaaggagggtgtcagggtcacaggaacacctgcaaactggaagagaactcagtggtacttatgggccagggcaatggcgacagcagacaccagcttctgccaggcagcctgcacttcaggggtgaactccttgccaaagtgagtagccagaataatcaccatcacgttacccaggagctgttaggcaaaagacaaaataacacacaggcatgttgagtagaagtttccgaaaacaacttgatgaaaaaacaaacaaacaaacaaaaacggctttatacctacattcctagacaaccctgacctcaaactgttccaaggtttgtgcccacccaaaaaattcagatgagcttaggttcaattttattctatgagccctacattcaacattctacctacctacaccctcacccccttccccattttaccagtattattgggttccctctctccctgtttttctttaagcaattgtctaatttttgtaaatgtagaatgtgagtgctgcaagagttctcagcgggagtttaaaatccccaacaaattcggaaacaagccttcacttggtcacaatactgatgggaaatttaacatattttagaaaatgtgtcttatttttctttgagcaaatcttttattttttttgcaaaaatctctttctaaacctcaattatcatgacccacataaaataaggcatttctatttccttgaaatggactttcatctaccaaaagccaaatttcattcttctttcacaagtctacaattctataatacaattctctgggataaacacatcaagttctggcaagatttcctgaaaagttaagccaattcaggctgttagtagtcctttactgtcactagttctgaatcatgtaagttttggttatgctcactagaagtctgctgttctaacatcaagctcgacccatgatttctgagatctttgttggtctttccaataagattatgagcttcaattaatgtcaaaatataaagccaaaaaatcacatcaccagcacctgaactcaccttgaagttctcaggatccacatgcagcttgtcacagtgcagctcactcagcttagcaaaggcgggcttgaggttgtccatgtttttaatagcatctccaaaggaagtcagcaccttcttgccatgggccttgaccttggggttgcccaggatggcagagggagacgacaggtttccaaagctgtcaaaaaatctctgggtccaggggtaaacaacgaggagtctatgaaatgacaccatatcagatacaaaattagagatgcaaaaaatcttgaggactttcccaatcaacttgctagggtaatattcacccttcattcccatgcattgagaaccaatgcttacctgcccaaggcttcacctccagcctcttccacattcatcttgctccacaggctagtgacggcagccttctcctcagcagtaaaatgcaccatgatgccaggcctgagagcttgctagtgattgcagctgtgtcggaagcagatatgtgctgctgcctctctgtctggccttttattctttactgccgaagttctggccccctgttctccatggtacttaaaagtcattggtcaaggctgacctgtgtccctcaggggtggagtcaggtccggagagggtcagcagtgatggatggacactaagtttgtgataatgtgtgctggatcctgaggctcttttttgttggctcctcatctatctgcaacacaaatttccatttgtccccttttttaccctcttcatcatcttccaaaatgatatccatctctcccattctccttttccaagaaagcctcatataaaggagcaaatctcaaaataggaaaaaaagtttcagccaaagcgcatttaacatttgccttaaaggtggtgacagtgacaaaaacagggccaaggaaaagaaaataaagctgttaaaacagaatctcacccagttctagctctcttaaggagtgcattgtaaacaaaacttctgtaccttagtttctctagggagacaaaaaccgtacatagttccttctagaaactgaacagaatagcaagtagtccacagtgggactaaagccttaatcccaaagtacagtaccttggggtgattccctagagaggacagacagaaaagattacatccagtgcttccagagaatcctctctcttttcatttctctatgaccacaggggacattggctactttgtgagtattgcctggggctctcttcttgcttgcctgtctgtcctgcttatacttctcactgggaagggagctgagaagcctaaaatcctaaaattatttaaagccagaatttgtcatcaaacagagaaaaaagtgaatcgatatattaatcaggctaggagtcagggtatattattcctctagtgtccttttttttttctgtatgtccccattttgatgacttgctagctctttacttggtagagctgaaactggaagttgggatttacagtgtattcaattcgatccatgtgcctgaagaatattgctcatgctatatcacttaatctgcccttataataccattgtcattatcctcatattttagaatcaaggaataaattcacagaaattatttaactatcaatgtgacagaagtaatgattgggggaataatagaagcagagttccacaaattccagcattgttaattctataaaagtcccttacatcaccataatctcattgccccagcccagttcctccttctggcttgttctacatccatttattttttcttttttctttttcttttctttctttcttttttttttttttttgagacggagtctcactctgttgccagactggagtgcaatggcactatctcagctcactgcaaccttcgcctcctgggttcaaacgattctcctgcctcagcctcccgagcagctgggactacaggcgcatgccaccatgcccagctaatttttttatttttagtagagacgggatttcaccatgtttgccaggatggtctcgatctcttgacctcatgatctgcccacctctgcctccgtctccatccatttctaccatttctttctcctatggctccccttgccccaccagatctaggaatttctgttcctacaatttcctgtatgttcaggccctagaggttcttcgtctttttcacttagcagtatggctcctgtctcccaagtcaagtgcctttggggattccatattccaagtttactaagagcgtttctctcttctataacctgactttgttatttattatattttcttatgtttgtgataaaaaaaaaaaaaaaaaaaaacacttgtggcaagtaagaatgtctcccttgcttttctcccatgattccagaagtcttcacctgacttaatgactgcccaaattgttattattccaggccactgaatttctactccattttcttttagctattaaccaatggtatctttctgagcatatattctaaccattggctaacacagacaaaaccaggaattcctaaactttttttgtgtcacaggccagtttggcagactgtaagtgctaaaaaaatatgtttttattgcatcaaataatatacataggagtgctaagtttaattacactgaaatatcattatcagacatcaaacattacatttgtggtatagtatttattatatttgcttctttatgaaagcattagatctaggattgggtctacagctaccttaagatccaagtagtgatgcagataaatgtgaattaaaaatatctgcaatgggccaggcgtggtggctcacacctataatcccagcacttcaggaggccaaggcgggcagatcatctgaggtcaggagttcaagaccagcctggccaacatggcgaaaccccatctctactaaaaatacaaaaattagactggcatggtggcaggtgcctgtaatccccagctactcaggaggccaaggcaggagaattgcttgaatgcaggaaggggaggttgcagtgagccgaaatcatgccactgcactccagcctgggcaataagagcgaaactccatctcaaacaaaaacaaaaacaaaaagatctgcaatacctatggtgtagtatgaaaatatctgtggtttctctttataactatgcaataggtactgatgatgtcattctagtttgtcctttgcattcaaagtagaagaaaatgctaaatttcagttacatgtaagtaaaaatacagattttttttctataaacttcaccagccccctagtgttctgtggaccccagattaagacttcctgggacaaaatatatagcctaggaagacaagatcctaggtttggaaagaacgtatttgatccactgaaataaaagaacaatgactagacaaaaagcagctcagctgcttgtagcttgaaccaagctgagcttggctactcagagaagaacagtcgttgagataatataattttttttaaccaattaagatacagctctgggttttcagggggaatttgctacagatccacagtatgaaggcagtggcccttcctcagaacttgaatgtgagggtcagacattgccaaagtccaaggaataaggaccaggtatctcaaggccaagagtttggagaacaggtttctccctaaaacaagccctatgggtaatcccatcattcttcccattcagagtatggacaccagtcttctcttagattcagagtatggggttgatcctctcctgctccctcggagccagttgcagagcccacattttcttctctccttactgcctatggttccagacctggcttgcatccagggatctgacccattccatgtttccttatggctaaaggtggtagggaggagcttcaagaaaggttatagcattgaaaggcccaggtttgtgtctcagtaacaaggcttataaatcctgactcagaagtcaggtaggctgcgggcagtctcattattgcttcgatgcttgttggttcaagataaattgcttcacctgctcatttttaagcattttatttgtttatcatatgagataccatgaaaaatggattattgcttttctttcctatattaaaagcccaaagttcagagagataagtgttatggccatccaggatagatcagaaagattagacagtcagaaaaagtaatcagtaagaatattcatttattgtctatataattaaaattagtaaaataaaatctatgtatgtcttaagacatttaagtataaaggacttttagaaagaaacacccaaattcgatgaagattaattcctgcctgtttgggtttgctttagcatttgtaatttcttaagttctatgcaggattctaaaaactgtaagatgcctaatttaaacaaggaaacatccaatattttcttaaatctttctggctaatttatgacatatgtttaacctgaagagtcaaatattgtactgttcttagatgctattagtatgaaaaattatataaattagattcttgttaagtaaagtaggcccttcacttcactgaatgtttttcatggtattatctaagaaataaatactttaatgaatattctttaccacaaataacttactttatttttatttttaaaataggaaaaatataaacaaggcttgtaaaccactgataggaaaagagctgcttaggattctaaattagccagattttaaattattctgcttccattatgtatctaaatctatattctcagaacaaaaatagatgtaagcaaatgattctactagattttgtgttagattttgcattatccaggaatgacttggatatcacaagtcataaattctgtggctgccttgcaggaagcctgtggctattttctagtgtaattgtaaagaatgagagaatagaccataacaagtgttcaaactgttgctttcttgttttcaacttttattttaagttcaggggtacatgtacaggatgtgcaggtttgttacatagataaatgaatgtcaagggggtttgttgtatagatgatctcatcactcaggtattacgcttagcatccattagtgatttttcctgatcctctccttctctcaccctccaccctctgataggccccagtatgcgttgtttccctctatgagtccatgtgttctcatcatttagcttctaactgttgctttcgtagtgtacctctgcctcatctctcacgaagtttgcaggtgagtttgagccagggctgaggctcattctcaagagtaatctctctctctggcaacttggagcacagacatcctattgtgtgactgacctcgggagccactgtgcctaaagtacaaccagagttacttgtgaatgttaattaagcaggagggatctttaatgggaaaaaggagtagaaagccagaatcagccagttatgccacactttcctacatgatgggcactgaaggttaaaacttgagtctgtcaacttagaaaactcataaatatcccattttccgctgaaatatagctttactttcctggtttctttgaccttttgggaccttgagtaagtaaagatgccttcatttattttcatgattaaaattctaagaaattcttgggtttttttaattaaattgcattgcctaatgtatttatgaactaagaacatagaaataaaacaatactctgaagtagttcagaatgtgctttcaatttatataaagagttaattcaaatgagactattttaagtgcagggctttgaatcttatgtctagaaattttgaaaaacctctgattatatgctaagattccacctctagtgctagaactgagaagtccttgacttggtgatcttttttaaattctgaaacaacagcaacataaagctaaggactttttcttgcctatgcatgctatcttcagtactttgattatttagtattgaaactataacatagtatgtttcctgaataaaaaatgtgtatttctctggagaaggttaaaactgaggattggcaagtgagcaaggcttaaatggaagaagcaatgatctcgtcagaccaccttcattaacgagatcatccatcatgaggaaatatggaaaaccaggccccctctgttttgtgtcactaagggtgaggatgctgaatgatttttccctcccccgggcttcttttagccatcaataattctagccccacaggagtttgttctgaaagtaaacttccacaaccgcaagcttattgaggctaaggcatctgtgaaggaaagaaacatctcctctaaaccactatgctgctagagcctcttttctgtactcaagcctcattcagacactagtgtcaccagtctcctcatatacctattgtattttcttcttcttgctggtttagtcatgttttctgggagcttaggggcttattttattttgttttgttttctaatcaacagagatgggcaaacccattatttttttctttagacttgggatggtgatagctgggcagcgtcagaaactgtgtgtggatatagataagagctcaggactatgctgagctgtgatgagggaggggcctagctaaaggcagtgagagtcagaatgctcctgctattgccttctcagtccccacgcttggtttctacacaagtagatacatagaaaaggctataggttagtgtttgagagtcctgcatgattagttgctcagaaatgcccgataaatatgttatgtgtgtttatgtatatatatgttttatatatatatatatgtgtgtgtgtgtgtgtgtgtgtgttgtgtttacaaatatgtgattatcatcaaaacgtgagggctaaagtgaccagataacttgcaagtcctaggataccaggaaaataaattacattccaaaaatttaactgagactttaaaaaaaaaaaaaaaacaaaaaaaaaccagtgatccatggacacagggaggggaacatcacacactggggcctgttgggggtggggggctaggggaaggatagcattaggagaaatacctaatgtagatgacgggttgatgggtgcagcaaaccaccatggcacatgtaccccagaacttaaagcatattaaaaaaacagtgatcataaaagaagctcaaatttaactataagagacggaatggctcccacaattcttaactataatcttacagaatattctcattgaatagaagtatgcttatcattagagatttggacagccaggaaagcacagaaaaaaaaaaaaggagctctgttgccttatagcctagaggtgttttgaacctcacataacactgatgtccaggccaaggccatccttcccatgaagatggatgaataagccatatctgacacctatgaaataatgtttactttagtggcatattgcattaggctacctgccttggcacagtttttctttacttttacctgactgatgaaacaattaattgcttacataaacatgagtgctctagttataaattccagtgtaaaaaacaccctggtttcgatattcatcttttgagccttttattttggtcagaacaagttttcaagagcaaatctcagcctacaaaacaaatgagtccaattctagaactcagtaatcccatcaaggctctgcctgcggagggctaactagctctatgcaggcttagcacttccagctctactccactgatttctttgtgtgtgcatagcagtggatgtgtcagcatacatccttttaattatagttgtatatgtgtttgactgctcattcattcattcaaaattgtaaaattgctaagaatacagcacaaaaacagaatagaggaataaagttcctgttttcatggacttgatagtggaaagagcttgacattaaataagcaaatgaaacatgttatataccaatgagattaggtgctatggagaaaaaaaaaaaactgaaatgaaggccagagtgtgattaggacagggtgaaagggtatcgctactttaagtagtatggcaggaaagtcctcactataaagttaacacctgagagagtacccatagatgatgaggaacccatttatatgaaactatgattaaatatttagggcatagggaatggcaaatgtaaataccctaaagatgtaagatgcttagaattttcaaggaatatcaataaggccaatgtaggatgagattcggtgaaggggagaataaaagatgagatcatagaagtcctaaattataaaatttgggacactaataatacctacatcatagagttgtaagaaaaaacactctacacacatacacataaatatatatatttatttatatgagagctatatatatgtatctgtaataaacataatatatgcatgaacaactattgtagagaattgtaaggatttggttttattataaatgatataggaaactatcagaagactttgaacaaagaggtgaccatatatgacttacattttgaaaagactaatttggatagtatattgggaagaaattgtagtggggcagtggtagaagcaggaagattgttatgagtcaacagctataatttaggtggtggtgacagtgacttagaccagagtggtagcattggaggtgaaggcaaggggtcagcctctgaaaacatcctttcacgaaaaaccaacaggattttctgacagagaatatggaattggtgtgtgtgtgtgttgcactcatgcacactctagtgcatgctaatttctggctgtgagtatatgtcagagtaaggattttgaagctaggcaaagtgagtctttgggttgaattttgtcaaggtgtttgttcatcacagtctctacctcagaattggctttaaaattggaaagctgggtgggtggatatggaaatgagaaaccatctctggagcttgtctacacatcatacctttagccaaagtgacatcaagtatttcttggatgctgaccagaggcttctgagccaggcccctctagctgaaggaagttcacagtttctttaaggagggaaaatggtagataagtcagagaacaatcagacagaattctgttcggtcagggaatttgatgggttttgtttgtttgtttgtttgtttgttttcgtttttctttagacagagtctcgctctggaggctggagtgcaatggcatgatctctgctcagtgcaaactccacctccccggttcaagcgattctcctgcctcagcctcccaagtagttggattacaggctcccgtcaccacgtccagctaatttttatatttttaagcagagaccaggtttcactatgttggctgggctggtgtccaactcctgacctcaagtgatctgcccaccttggcgtcccaaactgctgtgattacaggagtgagccaccgcacctcaaggaatttgatgtttaggctgtgacctctgcactaggaatggaaggttagccactcccaccccacccttcgtcctgcaagtacccaatcacactgcagagccacacctgccttccttagaggcgtgcctccatccctgatgagtttttcctccatgtgtagaattgaataagaaggatagaattcaatttaacaagctttgagtacttcctatagcctaggcattgtgctgacaactatgttagagagagaaatagacaagctataaacttttcctcaggaccatctacataatttctaggcccaatataaaatgaaaatgaatagcccctttgtcaaaaattaaggatttcatgtcaggaacagcaaggatgttaaaccaagcatggggccatcaagctatatctgctattcatgatacgaaaaaataaagagtattctagttatttagccacatatttcaagtttagtctgatatcaccctttaaacactgccactcaacctaaaacaatgctagtctttctagacccatccatggaattttttccccactgttttttttctaattaatttgtgatttaaatggctcatattccagcctgtgccacagttattacacatttaactcactctctgtattttgttatctgtataaatactcttcaggttgatttcctttcttaatgtttgtgtttatgttagatatgcatcatgtagcctgtcttcatttctatcacaaacatacacttgaaccaaaaaggaagtttttacatagcatcactaaatcttctctctgtgctcttagcgaaaccaagtaggctgacaagacatcattcattcacagcgaaaccgagtagactgacaagaggtcattcattcacaaatgaatacaaaaaacagtgtcaagtatacgtgaggtcctgtaatgggtcctgggcctgcaaaaccctcacagctgctaacctcaagaagctcagtggagacataacattcatctgaaaattccttgcatgtctgttgaactaatttatctgcctctccttaaatttgttcctttttgtatagttccttaagtcatgtcacatttctgaaacatctttgccactgtgaactcctacagaagccagcttcaaagccattcttctggaagccttctctatccccttgacctcctgttttttctcccacaagcattatgtctgtctgtcattgtttttcatcctcttgtagtccttcacagttacccacacaggtgaacccttttagctctcctggaggaatgtttctttcctctcaggatcagagttgcctacatcttcctaatgcaccaagactggcctgagatgtatccttaagatgagagcttcccagtagcaccccaagtcagatctgaccccgtatgtgagcatgtgtcctctaacagcacaggccttttgccacctagctgtccaggggtgccttaaaatggcaaacaaggtttgttttcttttcctgttttcatgccttcctcttccatatccttgtttcatattaatacatgtgtatagatcctaaaaatctatacacatgtattaataaagcctgattctgccgcttctaggtatagaggccacctgcaagataaatatttgattcacaataactaatcattctatggcaattgataacaacaaatatatatatatatatatatatacgtatatgtgtatatatatatatatattcaggaaataatatattctagaatatgtcacattctgtctcaggcatccattttctttatgatgccgtttgaggtggagttttagtcaggtggtcagcttctccttttttttgccatctgccctgtaagcatcctgctggggacccagataggagtcatcactctaggctgagaacatctgggcacacaccctaagcctcagcatgactcatcatgactcagcattgctgtgcttgagccagaaggtttgcttagaaggttacacagaaccagaaggcgggggtggggcactgaccccgacaggggcctggccagaactgctcatgcttggactatgggaggtcactaatggagacacacagaaatgtaacaggaactaaggaaaaactgaagcttatttaatcagagatgaggatgctggaagggatagagggagctgagcttgtaaaaagtatagtaatcattcagcaaatggttttgaagcacctgctggatgctaaacactattttcagtgcttgaatcataaataagaataaaacatgtatcttattccccacaagagtccaagtaaaaaataacagttaattataatgtgctctgtcccccaggctggagtgcagtggcacgatctcagctcactgcaacctccgcctcccgggttcaagcaattctcctgcctcagccaccctaatagctgggattacaggtgcacaccaccatgccaggctaatttttgtactttttgtagaggcagggtatcaccatgttgtccaagatggtcttgaactcctgagctccaagcagtccacccacctcagcctcccaaagtgctgggattacaggtgtgagacaccatgcccagattttccatatttaatagaggtatttatgggatgggggaaaagaatgtttctctcactgtggattattttagagagtggagaatggtcaagatttttttaaaaattaagaaaacataagttggaccttgagaaatgaaaatttatttttttgttggaggatacccattctctatctcccatcagggcaagctgtaaggaactggctaagacacagtgagacagagtgacttagtcttagaggccccactggtacccagatgagaaggcaccttcatcactcatcacagtcagctctgcctttctcctctctcctttctcatcagaaatttcataagtctactagggtcaggcagatcacataagaaaagaggatgccagttaaggtctgcagtgagtatgagcccatccctgatgaattaaggcaatcaacactttaggcagccatgttgccatgagagattaggaggggccaaatgagcccagaaataccacctacttcttagatgatcttgagcaagttgcttaacttcttgaagtctctgaaatataggatgataatatgtattagctaatagaattatgaggatgagattagtttattgtgtaaagaactagggacacagtatatattcagtaagtgttttctgttacagtattatgataaatatatacatgcaactattacagttgcatgctaccttaaagaataattggaggtacagttattcgga

SEQ ID NO: 7 - DNA, 25586 bp, Homo sapiens
aaaaagtcagtggtagcttgatggggatagcattgaatctataaattactttgggcagtatggccattttaaagatattgattctttctatctatgagcatggaatgtttttccatttgtttgtgtcctctcttatttccttgagcagtgagtggtttgtagctctccttgaagaggttcttcacatcccttagaagttgtatttctaggtattttattttattctctttgcagcaattgtgaatgggagttcacccatgatttggctctctgcttgtctattattggtgtataggaacgcttgtgatttctgcacactgattttgtatcttgagactttgctgaagctgtttatcagcttaagattttgggctgagatgacagggtcttctaaatatacaatcatgtcatctgcaaacagagacaatttgacttcctctcttcctatttgaatatgctttatttctttctcttgcctgattgtcctggcgagaacttccaatactatgttgagtaagagtggcgagagggcatccttgtcttgtgccggttttcaaagcaaatgatttttaaatttccatcttgatttcattgttgacccaatgatcattcaggagcaggttatttaatttccctgtatttgcatggttttgaaggttccttttgtagttgatttccaattttattctactgtggtctgagagagtgcttgatataatttcaatttttaaaaatttattgaggcttgttttgtggcatatcatatggcctatcttggagaaagttccatgtgctgatgaatagaatgtgtattctgcagttgttgggtagaatgtcctgtaaatatctgttaagtccatttgttctttaaatccattgtttctttgtagactgtcttgatgacctgcctagtgcagtcagtggagtattgaagtcccccactattattatgttgctgtctagtctagtagtaattgttttataaatttgggatctccagtattagatgcatatatattaagaattgtaatattctcccattggacaagggcttttatcattatatgatgtccctctttgtcttttttaactgctgtttctttaaagtttgttttgtctgacataagaatagctgctttggctcgcttttggtgtccatttgtgtggaatgtcattttccacccctttaccttaagtttatgtgagtccttatgtgttaggtgagtctcctgaaggcggcagataactggttggtgaattcttattcattctgcaattctgtatcttttaagtggagcatttagtccatttacattcaacatcagtattgaggtgtgaggtactattccattcttcgtggtatttgttgcctgtgtatctttttatctgtatttttgttgtatatgtcctatgggatttatgctttaaagaggttctgttttgatgtgcttccagggtttatttcaagatttagagctccttttatcagttcttgtagtgttggcttggtagtgccgaattctctcagcatttgtttttctgaaaaacactgtgtattttcttcatttgtgaagcttagtttcactggatataaaattcttggctgataattgttttgtttaagaaggctgaagatagggccatattcacttctagcttttacggtttctgctgagaaatctgctgttaatctgataggttttctttcataggttacctggtagtttcacctcacagctcttaagattctctttgtctttagataactttggatactctgatgacaatgtacctaggcaatgatatttttgcaatgaatttcccaggtgtttattgagcttcttgtatttggatatctaggtctctagcaaggtgggggaagttttccttgattatttccctggataagttttccaaacttttagatttctcttctttctcaggaatgctgattattcttaggtttgattgtttaacataatcccagatttcttggaggctttgttcatattttcttattcttttttctttgtctttgttggattgggttaattcaaaaactttgtcttcaagctctgaatttcttctgcttggattctattgctgagactttctagagcattttgcatttctataagtgcatccattcatccattgtttcctgaagttttgaatgttttttatttatgctatctctttaactgaagatttctcccctcatttcttgtatcatatttttggtttttttaaaattggacttcaccttcctcggatgcctccttgattagcttaataactgaccttctgaattatttttcaggtaaatcagggatttcttcttggtttggatgcattgctggtgagctagtatgattttttggggggtgttaaagaaccttgtttttcatattaccagagttagttttctggttccttctcacttgggtaggctctgtcagagggaaagtctaggcctcaaggctgagacttttgtcccatgaggtgttcccttgatgtagcacagtcccccttttcctaggcgtggggcttcctgagagccgaactgtagtgattgttatctctcttctggatctagccacccatcaggtctaccagactccaggctggtactggggtttgtctgcacagagtcttgtgacgtgaaccatctgtgggtctctcagccatagatacaaccacctgctccaatggaggtggcagaggatgaaatggactctgtgagggtccttacttttggttgttcaatgcactatttttgtgctggttggcctcctgccaggaggtggcactttctagaaagcatcagcagaggcagtcaggtggtggtggctgggggggctggggcaccctagaactcccaagaatatatgccctttgtcttcagctaccagggtgagtaaggaaggaccatcaggtgggggcaggactagtcgtgtctgagctcagagtctccttgggcaggtctttctgtggctactgtgggaggatgggggtgtagtttccaggtcaatggatttatgttcctaggacaattatggctgcctctgctgtgtcatgcaggtcatcaggaaagtgggggaaagcaagcagtcacgtgacttgcccagctcccatgcaactcaaaaggttggtctcacttccagcgtgcaccctcccccgcaacagcaccgaatctgtttccatgcagtcagtgagcaaggctgagaacttgccccaggctaccagctgcgaaaccaagtagggctgtcctacttccctgccagtggagtctgcacaccaaattcatgtccccccaccaacccccccactgcccagcccctagatctggccaggtggagattttctttttcctgtcatcttttcccagttcctctggcagccctcccaaatgacccctgtgaggcaaggcagaaatggcttcctaggggacccagagagcccacagggcttttcccgctgcttcctctacccctgtattttgcttggccctctaaattgactcagctccaggtaaggtcagaatcttctcctgtggtctagatcttcaggttccccagtgaggatgtgtgtttgggggtagacggtcccccttttccacttccacagtttgggcactcacaatatttggggtgtttcccgggtcctgcaggagcaatctgcttctttcagagggtgtgtgcgttctctcagctttcttgatttatttctgcaggtggttctgcaaaaaaaattcctgatgggagacttcacatgctgctctgtgcatccgagtgggagctgcaatgtacttctgctgcctcccatctgccatcaccctctaatttgtcggtaatatgcatttttaatcaatctttttttctctctctctctttttcttctcccccaaaactatactgccctttgatatcaaggaatcaaggacgtgatgttgaggggtgggcagtggatacactctttaccccttagggagctatatctagatttagatattgccaattcaagataacttaattgaaagcaaattcataatgaatacacacacacacacacacatctgcatgacaagatttttaatagttgaaagaataactaataattgtccacaggcaataagggctttttaagcaaaacagttgtgataaacaggtcattcttagaatagtaatccagccaatagtacaggttgcttagagattatgtcattaccagagttaaaattctataatggcttctcactccctaccactgaggacaagtttatgtccttaggtttatgcttccctgaaacaataccacctgctattctccactttacatatcaacggcactggttctttatctaactctctggcacagcaggagtttgttttcttctgcttcagagctttgaatttactatttcagcttctaaactttatttggcaatgccttcccatggcagattccttctgtcattttgcctctgttcgaatactttctccttaatttcattcttagttaataatatctgaaattattttgttgtttaacttaattattaattttatgtatgttctacctagattataatcttcagaggaaagttttattctctgacttatttaacttaaatgcccactactttaaaaattatgacatttatttaacagatatttgctgaacaaatgtttgaaaatacatgggaaagaatgcttgaaaacacttgaaattgcttgtgtaaagaaacagttttatcagttaggatttaatcaatgtcagaagcaatgatataggaaaaatcgaggaataagacagttatggataaggagaaatcaacaaactcttaaaagatattgcctcaaaagcataagaggaaataagggtttatacatgacttttagaacactgccttggtttttggataaatggggaagttgtttgaaaacaggagggatcctagatattccttagtctgaggaggagcaattaagattcacttgtttagaggctgggagtggtggctcacgcctgtaatcccagaattttgggaggccaaggcaggcagatcacctgaggtcaagagttcaagaccaacctggccaacatggtgaaatcccatctctacaaaaatacaaaaattagacaggcatgatggcaagtgcctgtaatcccagctacttgggaggctgaggaaggagaattgcttgaacctggaaggcaggagttgcagtgagccgagatcataccactgcactccagcctgggtgacagaacaagactctgtctcaaaaaaaaaaaagagagattcaaaagattcacttgtttaggccttagcgggcttagacaccagtctctgacacattcttaaaggtcaggctctacaaatggaacccaaccagactctcagatatggccaaagatctatacacacccatctcacagatcccctatcttaaagagaccctaatttgggttcacctcagtctctataatctgtaccagcataccaataaaaatctttctcacccatccttagattgagagaagtcacttattattatgtgagtaactggaagatactgataagttgacaaatctttttctttcctttcttattcaacttttattttaacttccaaagaacaagtgcaatatgtgcagctttgttgcgcaggtcaacatgtatctttctggtcttttagccgcctaacactttgagcagatataagccttacacaggattatgaagtctgaaaggattccaccaatattattataattcctatcaacctgataggttaggggaaggtagagctctcctccaataagccagatttccagagtttctgacgtcataatctaccaaggtcatggatcgagttcagagaaaaaacaaaagcaaaaccaaacctaccaaaaaataaaaatcccaaagaaaaaataaagaaaaaaacagcatgaatacttcctgccatgttaagtggccaatatgtcagaaacagcactgagttacagataaagatgtctaaactacagtgacatcccagctgtcacagtgtgtggactattagtcaataaaacagtccctgcctcttaagagttgttttccatgcaaatacatgtcttatgtcttagaataagattccctaagaagtgaacctagcatttatacaagataattaattctaatccatagtatctggtaaagagcattctaccatcatctttaccgagcatagaagagctacaccaaaaccctgggtcatcagccagcacatacacttatccagtgataaatacacatcatcgggtgcctacatacatacctgaatataaaaaaaatacttttgctgagatgaaacaggcgtgatttatttcaaataggtacggataagtagatattgaagtaaggattcagtcttatattatattacataacattaatctattcctgcactgaaactgttgctttataggatttttcactacactaatgagaacttaagagataatggcctaaaaccacagagagtatattcaaagataagtatagcacttcttatttggaaaccaatgcttactaaatgagactaagacgtgtcccatcaaaaatcctggacctatgcctaaaacacatttcacaatccctgaacttttcaaaaattggtacatgctttaactttaaactacaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggcaatgttttagggcctaaggagtgcctctgaaaatctagatggacaactttgactttgagaaaagagaggtggaaatgaggaaaatgacttttctttattagatttcggtagaaagaactttcacctttcccctatttttgttattcgttttaaaacatctatctggaggcaggacaagtatggtcattaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgcgcgcgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcacacatggttgtcttcagttctttttttatgtctttttaaatatatgagccacaaagggttttatgttgagggatgtgtttatgtgtatttatacatggctatgtgtgtttgtgtcatgtgcacactccacacttttttgtttacgttagatgtgggttttgatgagcaaataaaagaactaggcaataaagaaacttgtacatgggagttctgcaagtgggagtaaaaggtgcaggagaaatctggttggaagaaagacctctataggacaggactcctcagaaacagatgttttggaagagatggggaaaggttcagtgaagggggctgaacccccttccctggattgcagcacagcagcgaggaaggggctcaacgaagaaaaagtgttccaagctttaggaagtcaaggtttaggcagggatagccattctattttattaggggcaatactatttccaacggcatctggcttttctcagcccttgtgaggctctacagggaggttgaggtgttagagatcagagcaggaaacaggtttttctttccacggtaactacaatgaagtgatccttactttactaaggaacttttcattttaagtgttgacgcatgcctaaagaggtgaaattaatcccatacccttaagtctacagactggtcacagcatttcaaggaggagacctcattgtaagcttctagggaggtggggacttaggtgaaggaaatgagccagcagaagctcacaagtcagcatcagcgtgtcatgtctcagcagcagaacagcacggtcagatgaaaatatagtgtgaagaatttgtataacattaattgagaaggcagattcactggagttcttatataattgaaagttaatgcacgttaataagcaagagtttagtttaatgtgatggtgttatgaacttaacgcttgtgtctccagaaaattcacatgctgaatccccaactcccaattggctccatttgtgggggaggctttggaaaagtaatcaggtttagaggagctcatgagagcagatccccatcatagaattattttcctcatcagaagcagagagattagccatttctcttccttctggtgaggacacagtgggaagtcagccacctgcaacccaggaagagagccctgaccaggaaccagcagaaaagtgagaaaaaatcctgttgttgaagtcacccagtctatgctattttgttatagcaccttgcactaagtaaggcagatgaagaaagagaaaaaaataagcttcggtgttcagtggattagaaaccatgtttatctcaggtttacaaatctccacttgtcctctgtgtttcagaataaaataccaactctactactctcatctgtaagatgcaaatagtaagcctgagcccttctgtctaactttgaattctattttttcttcaacgtactttaggcttgtaatgtgtttatatacagtgaaatgtcaagttctttctttatatttctttctttcttttttttcctcagcctcagagttttccacatgcccttcctactttcaggaacttctttctccaaacgtcttctgcctggctccatcaaatcataaaggacccacttcaaatgccatcactcactaccatttcacaattcgcactttctttctttgtcctttttttttttagtaaaacaagtttataaaaaattgaaggaataaatgaatggctacttcataggcagagtagacgcaagggctactggttgccgatttttattgttatttttcaatagtatgctaaacaaggggtagattatttatgctgcccatttttagaccataaaagataacttcctgatgttgccatggcatttttttccttttaattttatttcatttcattttaatttcgaaggtacatgtgcaggatgtgcaggcttgttacatgggtaaatgtgtgtctttctggccttttagccatctgtatcaatgagcagatataagctttacacaggatcatgaaggatgaaagaatttcaccaatattataataatttcaatcaacctgatagcttaggggataaactaatttgaagatacagcttgcctccgataagccagaattccagagcttctggcattataatctagcaaggttagagatcatggatcactttcagagaaaaacaaaaacaaactaaccaaaagcaaaacagaaccaaaaaaccaccataaatacttcctaccctgttaatggtccaatatgtcagaaacagcactgtgttagaaataaagctgtctaaagtacactaatattcgagttataatagtgtgtggactattagtcaataaaaacaacccttgcctctttagagttgttttccatgtacacgcacatcttatgtcttagagtaagattccctgagaagtgaacctagcatttatacaagataattaattctaatccacagtacctgccaaagaacattctaccatcatctttactgagcatagaagagctacgccaaaaccctgggtcatcagccagcacacacacttatccagtggtaaatacacatcatctggtgtatacatacatacctgaatatggaatcaaatatttttctaagatgaaacagtcatgatttatttcaaataggtacggataagtagatattgaggtaagcattaggtcttatattatgtaacactaatctattactgcgctgaaactgtggctttatagaaattgttttcactgcactattgagaaattaagagataatggcaaaagtcacaaagagtatattcaaaaagaagtatagcactttttccttagaaaccactgctaactgaaagagactaagatttgtcccgtcaaaaatcctggacctatgcctaaaacacatttcacaatccctgaacttttcaaaaattggtacatgctttagctttaaactacaggcctcactggagctagagacaagaaggtaaaaaacggctgacaaaagaagtcctggtatcctctatgatgggagaaggaaactagctaaagggaagaataaattagagaaaaactggaatgactgaatcggaacaaggcaaaggctataaaaaaaattagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaaggtgagtccaggagatgtttcagccctgttgcctttagtctcgaggcaacttagacaacggagtattgatctgagcacagcagggtgtgagctgtttgaagatactggggttgggggtgaagaaactgcagaggactaactgggctgagacccagtggtaatgttttagggcctaaggagtgcctctaaaaatctagatggacaattttgactttgagaaaagagaggtggaaatgaggaaaatgacttttctttattagattccagtagaaagaactttcatctttccctcatttttgttgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgcgcgcgcgcgtgtgtgtgtgtgtgtcagcgtgtgtttcttttaacgtcttcagcctacaacatacagggttcatggtggcaagaagatagcaagatttaaattatggccagtgactagtgcttgaaggggaacaactacctgcatttaatgggaaggcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgtacacgggagttctgcaagtgggagtaaatggtgtaggagaaatccggtgggaagaaagacctctataggacaggacttctcagaaacagatgttttggaagagatgggaaaaggttcagtgaagacctgggggctggattgattgcagctgagtagcaaggatggttcttaaggaagggaaagtgttccaagctttaggaattcaaggtttagtcaggtgtagcaattctattttattaggaggaatactatttctaatggcacttagcttttcacagcccttgtggatgcctaagaaagtgaaattaatcccatgccctcaagtgtgcagattggtcacagcatttcaagggagagacctcattgtaagactctgggggaggtggggacttaggtgtaagaaatgaatcagcagaggctcacaagtcagcatgagcatgttatgtctgagaaacagaccagcactgtgagatcaaaatgtagtgggaagaatttgtacaacattaattggaaggcttacttaatggaatttttgtatagttggatgttagtgcatctctataagtaagagtttaatatgatggtgttacggacctaatgtttgtgtctcctcaaaattcacatgctgaatccccaactcccaactgaccttatctgtgggggaggcttttgaaaagtaattaggtttagatgagctcataagagcagatccccatcataaaattattttccttatcagaagcagagagacaagccatttctctttcctcccggtgaggacacagtgagaagtccgccatctgcaatccaggaagagaaccctgaccacgagtcagccttcagaaatgtgagaaaaaactctgttgttgaagccacccagtcttttgtattttgttatagcaccttgcactgagtaaggcagatgaagaaggagaaaaaaataagcttgggttttgagtggactacagaccatgtttatctcaggtttgcaaagctcccctcgtcccctatgtttcagtataaaatacctactctactactctcatctataagacccaaataataagcctgcgcccttctctctaactttgatttctcctatttttacttcaacatgctttactctagccttgtaatgtctttacatacagtgaaatgtaaagttctttattctttttttctttctttcttttttctcctcagcctcagaatttggcacatgcccttccttctttcaggaacttctccaacatctctgcctggctccatcatatcataaaggtcccacttcaaatgcagtcactaccgtttcagaatatgcactttctttcttttttgttttttgttttttttaagtcaaagcaaatttcttgagagagtaaagaaataaacgaatgactactgcataggcagagcagccccgagggccgctggttgttccttttatggttatttcttgatgatatgttaaacaagttttggattatttatgccttctctttttaggccatatagggtaactttctgacattgccatggcatttttcttttaatttaatttactgttaccttaaattcaggggtacacgtacaggatatgcaggtttgttttataggtaaaagtgtgccatggttttaatgggttttttttttcttgtaaagttgtttaagtttcttgtttactctggatattaggcctttgtcagaagaatagattggaaaatctttttcccattctgtagattgtctttcgctctgatggtagtttcttttgctgagcaggagctctttagtttaattagattccattggtcaatttttgcttttgctgcaattgcttttcacgctttcatcatgaaatctgtgcccgtgtttatatcatgaatagtattgccttgatttttttctaggctttttatagtttggggtttttcatttaagtctctaatccatctggagttaattttggataaggtataaggaaggagtccagtttcatttttcagcatatggctagccagttctcccccatcatttattaaattgaaaatcctttccccattgcttgcttttgtcaggtttctaaaagaccagatggttgtaggtacaatatgcagtttcttcaagtcatataataccatctgaaatctcttattaattcatttcttttagtatgtatgctggtctcctctgctcactatagtgagggcaccattagccagagaatctgtctgtctagttcatgtaagattctcagaattaagaaaaatggatggcatatgaatgaaacttcatggatgacatatggaatctaatatgtatttgttgaattaatgcataagatgcaacagagagaagttgacaactgcaatgataacctggtattgatgatataagagtctatagatcacagtagaagcaataatcatggaaaacaattggaaatggggaacagccacaaacaagaaagaatcaatacttccaggaaagtgactgcaggtcacttttcctggagcgggtgagagaaaagtggaagttagcagtaactgctgaattcctggttggctgatggaaagatggggcagctgttcactggtacgcagggttttagatgtatgtacctaaggatatgaggtatggcaatgaacagaaattcttttgggaatgagttttagggccattaaaggacatgacctgaagtttcctctgaggccagtccccacaactcaatataaatgtgtttcctgcatatagtcaaagttgccacttctttttcttcatatcatcgatctctgctcttaaagataatcttggttttgcctcaaactgtttgtcactacaaactttccccatgttcctaagtaaaacaggtaactgcctctcaactatatcaagtagactaaaatattgtgtctctaatatcagaaattcagctttaatatattgggtttaactctttgaaatttagagtctccttgaaatacacatgggggtgatttcctaaactttatttcttgtaaggatttatctcaggggtaacacacaaaccagcatcctgaacctctaagtatgaggacagtaagccttaagaatataaaataaactgttcttctctctgccggtggaagtgtgccctgtctattcctgaaattgcttgtttgagacgcatgagacgtgcagcacatgagacacgtgcagcagcctgtggaatattgtcagtgaagaatgtctttgcctgattagatataaagacaagttaaacacagcattagactatagatcaagcctgtgccagacacaaatgacctaatgcccagcacgggccacggaatctcctatcctcttgcttgaacagagcagcacacttctcccccaacactattagatgttctggcataattttgtagatatgtaggatttgacatggactattgttcaatgattcagaggaaatctcctttgttcagataagtacactgactactaaatggattaaaaaacacagtaataaaacccagttttccccttacttccctagtttgtttcttattctgctttcttccaagttgatgctggatagaggtgtttatttctattctaaaaagtgatgaaattggccgggcgcggtggctcacacctgtaatcccagcactttgggaggctgaggtgggcggatcacgaggtcaggagatcaagaccatcctggctaacatggtgaaaccccatctctactaaaaatacaaaaaattagccagagacagtggcgggtgcctgtagtcccagctactcgggaggctgaggcaggagaatggcgtgaacctgggaggcagagcttgcggtgagcagagatcgcgccactgcacactccagcctgggtgacaaagcgagactccatctcaaaaaaaaaaaaaaaaaaaagaaaaagaaagaaagaaagaaaaaaaaactgatgaaattgtgtattcaatgtagtctcaagagaattgaaaaccaagaaaggctgtggcttcttccacataaagcctggatgaataacaggataacacgttgttacattgtcacaactcctgatccaggaattgatggctaagatattcgtaattcttatccttttcagttgtaacttattcctatttgtcagcattcaggttattagcggctgctggcgaagtccttgagaaataaactgcacactggatggtgggggtagtgtaggaaaatggaggggaaggaagtaaagtttcaaattaagcctgaacagcaaagttcccctgagaaggccacctggattctatcagaaactcgaatgtccatcttgcaaaacttccttgcccaaaccccacccctggagtcacaacccacccttgaccaatagattcattttactgagggaggcaaagggctggtcaatagattcatttcactgggagaggcaaagggctgggggccagagaggagaagtaaaaagccacacatgaagcagcaatgcaggcatgcttctggctcatctgtgatcaccaggaaactcccagatctgacactgtagtgcatttcactgctgacaagaaggctgctgccaccagcctgtgaagcaaggttaaggtgagaaggctggaggtgagattctgggcaggtaggtactggaagccgggacaaggtgcagaaaggcagaaagtgtttctgaaagagggattagcccgttgtcttacatagtctgactttgcacctgctctgtgattatgactatcccacagtctcctggttgtctacccatggacctagaggtactttgaaagttttggatatctgggctctgactgtgcaataatgggcaaccccaaagtcaaggcacatggcaagaaggtgctgatctccttcggaaaagctgttatgctcacggatgacctcaaaggcacctttgctacactgagtgacctgcactgtaacaagctgcacgtggaccctgagaacttcctggtgagtagtaagtacactcacgctttcttctttacccttagatatttgcactatgggtacttttgaaagcagaggtggctttctcttgtgttatgagtcagctatgggatatgatatttcagcagtgggattttgagagttatgttgctgtaaataacataactaaaatttggtagagcaaggactatgaataatggaaggccacttaccatttgatagctctgaaaaacacatcttataaaaaattctggccaaaatcaaactgagtgtttttggatgagggaacagaagttgagatagagaaaataacatctttcctttggtcagcgaaattttctataaaaattaatagtcacttttctgcatagtcctggaggttagaaaaagatcaactgaacaaagtagtgggaagctgttaaaaagaggattgtttccctccgaatgatgatggtatacttttgtacgcatggtacaggattctttgttatgagtgtttgggaaaattgtatgtatgtatgtatgtatgtatgtgatgactggggacttatcctatccattactgttccttgaagtactattatcctactttttaaaaggacgaagtctctaaaaaaaaaatgaaacaatcacaatatgttggggtagtgagttggcatagcaagtaagagaaggataggacacaatgggaggtgcagggctgccagtcatattgaagctgatatctagcccataatggtgagagttgctcaaactctggtgaaaaaggatgtaagtgttatatctatttactgcaagtccagcttgaggccttctattcactatgtaccattttcttttttatcttcactccctccccagctcttaggcaacgtgatattgattgttttggcaacccacttcagcgaggattttaccctacagatacaggcttcttggcagtaactaacaaatgctgtggttaatgctgtagcccacaagaccactgagttccctgtccactatgtttgtacctatggtccactatgtttgtacctatgtcccaaaatctcatctcctttagatgggggaggttggggagaagagcagtatcctgcctgctgattcagttcctgcatgataaaaatagaataaagaaatatgctctctaagaaatatcattgtactctttttctgtctttatattttaccctgattcagccaaaaggacgcactatttctgatggaaatgagaatgttggagaatgggagtttaaggacagagaagatactttcttgcaatcctgcaagaaaagagagaactcgtgggtggatttagtggggtagttactcctaggaaggggaaatcgtctctagaataagacaatgtttttacagaaagggaggtcaatggaggtactctttggaggtgtaagaggattgttggtagtgtgtagaggtatgttaggactcaaattagaagttctgtataggctattatttgtatgaaactcaggatatagctcatttggtgactgcagttcacttctacttattttaaacaacatattttttattatttataatgaagtggggatggggcttcctagagaccaatcaagggccaaaccttgaactttctcttaacgtcttcaatggtattaatagagaattatctctaaggcatgtgaactggctgtcttggttttcatctgtacttcatctgctacctctgtgacctgaaacatatttataattccattaagctgtgcatatgatagatttatcatatgtattttccttaaaggatttttgtaagaactaattgaattgatacctgtaaagtctttatcacactacccaataaataataaatctctttgttcagctctctgtttctataaatatgtacaagttttattgtttttagtggtagtgattttattctctttctatatatatacacacacatgtgtgcattcataaatatatacaatttttatgaataaaaaattattagcaatcaatattgaaaaccactgatttttgtttatgtgagcaaacagcagattaaaaggctgagatttaggaaacagcacgttaagtcaagttgatagaggagaatatggacatttaaaagaggcaggatgatataaaattagggaaactggatgcagagaccagatgaagtaagaaaaatagctatcgttttgagcaaaaatcactgaagtttcttgcatatgagagtgacataataaatagggaaacgtagaaaattgattcacatgtatatatatatatagaactgattagacaaagtctaacttgggtatagtcagaggagcttgctgtaattatattgaggtgatggataaagaactgaagttgatggaaacaatgaagttaagaaaaaaaatcgagtaagagaccattgtggcagtgattgcacagaactggaaaacattgtgaaacagagagtcagagatgacagctaaaatccctgtctgtgaatgaaaagaaggaaatttattgacagaacagcaaatgcctacaagccccctgtttggatctggcaatgaacgtagccattctgtggcaatcacttcaaactcctgtacccaagacccttaggaagtatgtagcaccctcaaacctaaaacctcaaagaaagaggttttagaagatataataccctttcttctccagtttcattaatcccaaaacctctttctcaaagtatttcctctatgtgtccaccccaaagagctcacctcaccatatctcttgagtgggagcacatagataggcggtgctaccatctaacagcttctgaaattcctttgtcatatttttgagtccccactaataacccacaaagcagaataaataccagttgctcatgtacaataatcactcaactgctgtcttgtagcatacattaattaagcacattctttgaataattactgtgtccaaacaatcacactttaaaatctcacacttgtgctatcccttgcccttctgaatgtcactctgtattttaaatgaagagatgagggttgaatttcctgtgttacttattgttcatttctcgatgaggagttttcacattcacctttagtggaaaacacataagtacacatcttacaggaaaaatataccaaactgacatgtagcatgaatgcttgtgcatgtagtcatataaaatcttgtagcaatgtaaacattctctgatatacacatacagatgtgtctatatgtctacacaatttcttatgctccatgaacaaacattccatgcacacataagaacacacactgttacagatgcatacttgagtgcattgacaaaattaccccagtcaatctagagaatttggatttctgcatttgactctgttagctttgtacatgctgttcatttactctgggtgatgtctttccctcattttgccttgtctatcttgtactcatactttaagtcctaacttatatgttatctcaactaagaagctatttttttttaattttaactgggcttaaagccctgtctataaactctgctacaattatgggctctttcttataatatttagtgtttttcctactaatgtacttaatctgctcattgtatattcctaccactaaattttaacctcttttatggtagagacattgtcttgtaaactcttatttccctagtatttggagatgaaaaaaaagattaaattatccaaaattagatctctcttttctacattatgagtattacactatccatagagaagtttgtttgagacctaaactgaggaacctttggttctaaaatgactatgtgatatcttagtatttataggtcatgaggttccttcctctgcctctgctatagtttgattagtcaacaagcatgtgtcatgcatttattcacatcagaatttcatacactaataagacatagtatcagaagtcagtttattagttatatcagttagggtccatcaaggaaaggacaaaccattatcagttactcaacctagaattaaatacagctcttaatagttaattatccttgtattggaagagctaaaatatcaaataaaggacagtgcagaaatctagatgttagtaacatcagaaaacctcttccgccattaggcctagaagggcagaaggagaaaatgtttataccaccagagtccagaaccagagcccataaccagaggtccactggattcagtgagctagtgggtgctccttggagagagccagaactgtctaatgggggcatcaaagtatcagccataaaaaaccataaaaaagactgtctgctgtaggagatccgttcagagagagagagagaccagaaataatcttgcttatgctttccctcagccagtgtttaccattgcagaatgtacatgcgactgaaagggtgaggaaacctgggaaatgtcagttcctcaaatacagagaacactgagggaaggatgagaaataaatgtgaaagcagacatgaatggtaattgacagaaggaaactaggatgtgtccagtaaatgaataattacagtgtgcagtgattattgcaatgattaatgtattgataagataatatgaaaacacagaattcaaacagcagtgaactgagattagaattgtggagagcactggcatttaagaatgtcacacttagaatgtgtctctaggcattgttctgtgcatatatcatctcaatattcattatctgaaaattatgaattaggtacaaagctcaaataatttattttttcaggttagcaagaactttttttttttttttctgagatagagcattgctatggttgcccaggctggagtgcaatggcatgatccaggctcactgcaacatctgcctcccaggttcaagcgattctcctgcctcagcctcccaagtagctggcactacaggcatgtgccaccaccatgcctggctaattttctatttttagtagatagggggtttcaccatgttggtcaggctgatctcgaactcctaacatcaggtgatccaccctcctcggcctctgaaagtgctgggatcacaggcgtgagccaccacacccagccaagaatgtgaattttgtagaaggatataacccatatttctctgaccctagagtccttagtatacctcccataccatgtggctcatcctccttacatacatttcccatctttcaccctaccttttcctttttgtttcagcttttcactgtgtcaaaatctagaaccttatctcctacctgctctgaaaccaacagcaagttgacttccattctaacccacattggcattacactaattaaaatcgatactgagttctaaaatcatcggggattttggggactatgtcttacttcatacttccttgagatttcacattaaatgttggtgttcattaaaggtccttcatttaactttgtattcatcacactcttggattcacagttatatctaaactcttaaatacagcctgtataatcccaattcccaactctgatttctaacctctgacctccaacctcagtgccaaacccatatatcaaacaatgtactgggcttatttatatagatgtcctataggcacctcagactcagcatgggtatttcacttgttatactaaaactgtttctcttccagtgttttccattttagtcattagatagctacttgcccattcaccaaggtcacagattaaaatcatttccctacctctaatcaacagttcgattctgcttcaatttgtccctatctattaatcaccactcttactgcccagtcaggtcctcattgtttcctgaacaagagtagatgctattctttccacttttagaccttatcctggctggatgcggtggctcaggcttgtaaacccagcactttgggaggccaaggcaggcagatcacttgaggtcaggagttcaagaccagcctgaccaacatggtgaaaccccatctctactaaaaatacaaaatcagccgggcgtgtggtgcatgcctgcagtcccagctattcaggtggctgaggcaggagaattgcttgaacccaggaggcagaggttgcggtgagcctagattgcaccattgcactctagcttgggcaatagggatgaaactccatctcagaagagaaaagaaaaaaagaccttattctgttatacaaatcctctcaatgcaatccatatagaataaacatgtaaccagatctcccaatgtgtaaaatcatttcaggtagaacagaattaaagtgaaaagccaagtctttggaattaacagacaaagatcaaataacagtcctcatggccttaagaatttacctaacattttttttagaatcaattttcttatatatgaattggaaacataattcctccctcacaaacacattctaagattttaaggagatattgatgaagtacatcatctgtcatttttaacaggtagtggtagtgattcacacagcacattatgatctgttcttgtatgttctgttccattctgtattcttgacctggttgtattctttctgagctccagatccacatatctaagtacatctttttgcattttacaagagtgcatacaatacaatgtatccaagactgtatttctgattttatcgtaccactaaactcacaaatgtggccctattcttgtgttcacgactgacatcaccgtcatggtccaagtctgataatagaaatggcattgtcactttcttccctactgcaacagaagcccagctatttgtctcccattttctctacttctaaaatacatttcttcactaagtgagaataatcttttaaagacacaaat

SEQ ID NO: 8 - DNA, 25586 bp, Homo sapiens
atttgtgtctttaaaagattattctcacttagtgaagaaatgtattttagaagtagagaaaatgggagacaaatagctgggcttctgttgcagtagggaagaaagtgacaatgccatttctattatcagacttggaccatgacggtgatgtcagtcgtgaacacaagaatagggccacatttgtgagtttagtggtacgataaaatcagaaatacagtcttggatacattgtattgtatgcactcttgtaaaatgcaaaaagatgtacttagatatgtggatctggagctcagaaagaatacaaccaggtcaagaatacagaatggaacagaacatacaagaacagatcataatgtgctgtgtgaatcactaccactacctgttaaaaatgacagatgatgtacttcatcaatatctccttaaaatcttagaatgtgtttgtgagggaggaattatgtttccaattcatatataagaaaattgattctaaaaaaaatgttaggtaaattcttaaggccatgaggactgttatttgatctttgtctgttaattccaaagacttggcttttcactttaattctgttctacctgaaatgattttacacattgggagatctggttacatgtttattctatatggattgcattgagaggatttgtataacagaataaggtctttttttcttttctcttctgagatggagtttcatccctattgcccaagctagagtgcaatggtgcaatctaggctcaccgcaacctctgcctcctgggttcaagcaattctcctgcctcagccacctgaatagctgggactgcaggcatgcaccacacgcccggctgattttgtatttttagtagagatggggtttcaccatgttggtcaggctggtcttgaactcctgacctcaagtgatctgcctgccttggcctcccaaagtgctgggtttacaagcctgagccaccgcatccagccaggataaggtctaaaagtggaaagaatagcatctactcttgttcaggaaacaatgaggacctgactgggcagtaagagtggtgattaatagatagggacaaattgaagcagaatcgaactgttgattagaggtagggaaatgattttaatctgtgaccttggtgaatgggcaagtagctatctaatgactaaaatggaaaacactggaagagaaacagttttagtataacaagtgaaatacccatgctgagtctgaggtgcctataggacatctatataaataagcccagtacattgtttgatatatgggtttggcactgaggttggaggtcagaggttagaaatcagagttgggaattgggattatacaggctgtatttaagagtttagatataactgtgaatccaagagtgtgatgaatacaaagttaaatgaaggacctttaatgaacaccaacatttaatgtgaaatctcaaggaagtatgaagtaagacatagtccccaaaatccccgatgattttagaactcagtatcgattttaattagtgtaatgccaatgtgggttagaatggaagtcaacttgctgttggtttcagagcaggtaggagataaggttctagattttgacacagtgaaaagctgaaacaaaaaggaaaaggtagggtgaaagatgggaaatgtatgtaaggaggatgagccacatggtatgggaggtatactaaggactctagggtcagagaaatatgggttatatccttctacaaaattcacattcttggctgggtgtggtggctcacgcctgtgatcccagcactttcagaggccgaggagggtggatcacctgatgttaggagttcgagatcagcctgaccaacatggtgaaaccccctatctactaaaaatagaaaattagccaggcatggtggtggcacatgcctgtagtgccagctacttgggaggctgaggcaggagaatcgcttgaacctgggaggcagatgttgcagtgagcctggatcatgccattgcactccagcctgggcaaccatagcaatgctctatctcagaaaaaaaaaaaaaaagttcttgctaacctgaaaaaataaattatttgagctttgtacctaattcataattttcagataatgaatattgagatgatatatgcacagaacaatgcctagagacacattctaagtgtgacattcttaaatgccagtgctctccacaattctaatctcagttcactgctgtttgaattctgtgttttcatattatcttatcaatacattaatcattgcaataatcactgcacactgtaattattcatttactggacacatcctagtttccttctgtcaattaccattcatgtctgctttcacatttatttctcatccttccctcagtgttctctgtatttgaggaactgacatttcccaggtttcctcaccctttcagtcgcatgtacattctgcaatggtaaacactggctgagggaaagcataagcaagattatttctggtctctctctctctctgaacggatctcctacagcagacagtcttttttatggttttttatggctgatactttgatgcccccattagacagttctggctctctccaaggagcacccactagctcactgaatccagtggacctctggttatgggctctggttctggactctggtggtataaacattttctccttctgcccttctaggcctaatggcggaagaggttttctgatgttactaacatctagatttctgcactgtcctttatttgatattttagctcttccaatacaaggataattaactattaagagctgtatttaattctaggttgagtaactgataatggtttgtcctttccttgatggaccctaactgatataactaataaactgacttctgatactatgtcttattagtgtatgaaattctgatgtgaataaatgcatgacacatgcttgttgactaatcaaactatagcagaggcagaggaaggaacctcatgacctataaatactaagatatcacatagtcattttagaaccaaaggttcctcagtttaggtctcaaacaaacttctctatggatagtgtaatactcataatgtagaaaagagagatctaattttggataatttaatcttttttttcatctccaaatactagggaaataagagtttacaagacaatgtctctaccataaaagaggttaaaatttagtggtaggaatatacaatgagcagattaagtacattagtaggaaaaacactaaatattataagaaagagcccataattgtagcagagtttatagacagggctttaagcccagttaaaattaaaaaaaaatagcttcttagttgagataacatataagttaggacttaaagtatgagtacaagatagacaaggcaaaatgagggaaagacatcacccagagtaaatgaacagcatgtacaaagctaacagagtcaaatgcagaaatccaaattctctagattgactggggtaattttgtcaatgcactcaagtatgcatctgtaacagtgtgtgttcttatgtgtgcatggaatgtttgttcatggagcataagaaattgtgtagacatatagacacatctgtatgtgtatatcagagaatgtttacattgctacaagattttatatgactacatgcacaagcattcatgctacatgtcagtttggtatatttttcctgtaagatgtgtacttatgtgttttccactaaaggtgaatgtgaaaactcctcatcgagaaatgaacaataagtaacacaggaaattcaaccctcatctcttcatttaaaatacagagtgacattcagaagggcaagggatagcacaagtgtgagattttaaagtgtgattgtttggacacagtaattattcaaagaatgtgcttaattaatgtatgctacaagacagcagttgagtgattattgtacatgagcaactggtatttattctgctttgtgggttattagtggggactcaaaaatatgacaaaggaatttcagaagctgttagatggtagcaccgcctatctatgtgctcccactcaagagatatggtgaggtgagctctttggggtggacacatagaggaaatactttgagaaagaggttttgggattaatgaaactggagaagaaagggtattatatcttctaaaacctctttctttgaggttttaggtttgagggtgctacatacttcctaagggtcttgggtacaggagtttgaagtgattgccacagaatggctacgttcattgccagatccaaacagggggcttgtaggcatttgctgttctgtcaataaatttccttcttttcattcacagacagggattttagctgtcatctctgactctctgtttcacaatgttttccagttctgtgcaatcactgccacaatggtctcttactcgattttttttcttaacttcattgtttccatcaacttcagttctttatccatcacctcaatataattacagcaagctcctctgactatacccaagttagactttgtctaatcagttctatatatatatatacatgtgaatcaattttctacgtttccctatttattatgtcactctcatatgcaagaaacttcagtgatttttgctcaaaacgatagctatttttcttacttcatctggtctctgcatccagtttccctaattttatatcatcctgcctcttttaaatgtccatattctcctctatcaacttgacttaacgtgctgtttcctaaatctcagccttttaatctgctgtttgctcacataaacaaaaatcagtggttttcaatattgattgctaataattttttattcataaaaattgtatatatttatgaatgcacacatgtgtgtgtatatatatagaaagagaataaaatcactaccactaaaaacaataaaacttgtacatatttatagaaacagagagctgaacaaagagatttattatttattgggtagtgtgataaagactttacaggtatcaattcaattagttcttacaaaaatcctttaaggaaaatacatatgataaatctatcatatgcacagcttaatggaattataaatatgtttcaggtcacagaggtagcagatgaagtacagatgaaaaccaagacagccagttcacatgccttagagataattctctattaataccattgaagacgttaagagaaagttcaaggtttggcccttgattggtctctaggaagccccatccccacttcattataaataataaaaaatatgttgtttaaaataagtagaagtgaactgcagtcaccaaatgagctatatcctgagtttcatacaaataatagcctatacagaacttctaatttgagtcctaacatacctctacacactaccaacaatcctcttacacctccaaagagtacctccattgacctccctttctgtaaaaacattgtcttattctagagacgatttccccttcctaggagtaactaccccactaaatccacccacgagttctctcttttcttgcaggattgcaagaaagtatcttctctgtccttaaactcccattctccaacattctcatttccatcagaaatagtgcgtccttttggctgaatcagggtaaaatataaagacagaaaaagagtacaatgatatttcttagagagcatatttctttattctatttttatcatgcaggaactgaatcagcaggcaggatactgctcttctccccaacctcccccatctaaaggagatgagattttgggacataggtacaaacatagtggaccataggtacaaacatagtggacagggaactcagtggtcttgtgggctacagcattaaccacagcatttgttagttactgccaagaagcctgtatctgtagggtaaaatcctcgctgaagtgggttgccaaaacaatcaatatcacgttgcctaagagctggggagggagtgaagataaaaaagaaaatggtacatagtgaatagaaggcctcaagctggacttgcagtaaatagatataacacttacatcctttttcaccagagtttgagcaactctcaccattatgggctagatatcagcttcaatatgactggcagccctgcacctcccattgtgtcctatccttctcttacttgctatgccaactcactaccccaacatattgtgattgtttcattttttttttagagacttcgtccttttaaaaagtaggataatagtacttcaaggaacagtaatggataggataagtccccagtcatcacatacatacatacatacatacatacaattttcccaaacactcataacaaagaatcctgtaccatgcgtacaaaagtataccatcatcattcggagggaaacaatcctctttttaacagcttcccactactttgttcagttgatctttttctaacctccaggactatgcagaaaagtgactattaatttttatagaaaatttcgctgaccaaaggaaagatgttattttctctatctcaacttctgttccctcatccaaaaacactcagtttgattttggccagaattttttataagatgtgtttttcagagctatcaaatggtaagtggccttccattattcatagtccttgctctaccaaattttagttatgttatttacagcaacataactctcaaaatcccactgctgaaatatcatatcccatagctgactcataacacaagagaaagccacctctgctttcaaaagtacccatagtgcaaatatctaagggtaaagaagaaagcgtgagtgtacttactactcaccaggaagttctcagggtccacgtgcagcttgttacagtgcaggtcactcagtgtagcaaaggtgcctttgaggtcatccgtgagcataacagcttttccgaaggagatcagcaccttcttgccatgtgccttgactttggggttgcccattattgcacagtcagagcccagatatccaaaactttcaaagtacctctaggtccatgggtagacaaccaggagactgtgggatagtcataatcacagagcaggtgcaaagtcagactatgtaagacaacgggctaatccctctttcagaaacactttctgcctttctgcaccttgtcccggcttccagtacctacctgcccagaatctcacctccagccttctcaccttaaccttgcttcacaggctggtggcagcagccttcttgtcagcagtgaaatgcactacagtgtcagatctgggagtttcctggtgatcacagatgagccagaagcatgcctgcattgctgcttcatgtgtggctttttacttctcctctctggcccccagccctttgcctctcccagtgaaatgaatctattgaccagccctttgcctccctcagtaaaatgaatctattggtcaagggtgggttgtgactccaggggtggggtttgggcaaggaagttttgcaagatggacattcgagtttctgatagaatccaggtggccttctcaggggaactttgctgttcaggcttaatttgaaactttacttccttcccctccattttcctacactacccccaccatccagtgtgcagtttatttctcaaggacttcgccagcagccgctaataacctgaatgctgacaaataggaataagttacaactgaaaaggataagaattacgaatatcttagccatcaattcctggatcaggagttgtgacaatgtaacaacgtgttatcctgttattcatccaggctttatgtggaagaagccacagcctttcttggttttcaattctcttgagactacattgaatacacaatttcatcagtttttttttctttctttctttctttttcttttttttttttttttttttgagatggagtctcgctttgtcacccaggctggagtgtgcagtggcgcgatctctgctcaccgcaagctctgcctcccaggttcacgccattctcctgcctcagcctcccgagtagctgggactacaggcacccgccactgtctctggctaattttttgtatttttagtagagatggggtttcaccatgttagccaggatggtcttgatctcctgacctcgtgatccgcccacctcagcctcccaaagtgctgggattacaggtgtgagccaccgcgcccggccaatttcatcactttttagaatagaaataaacacctctatccagcatcaacttggaagaaagcagaataagaaacaaactagggaagtaaggggaaaactgggttttattactgtgttttttaatccatttagtagtcagtgtacttatctgaacaaaggagatttcctctgaatcattgaacaatagtccatgtcaaatcctacatatctacaaaattatgccagaacatctaatagtgttgggggagaagtgtgctgctctgttcaagcaagaggataggagattccgtggcccgtgctgggcattaggtcatttgtgtctggcacaggcttgatctatagtctaatgctgtgtttaacttgtctttatatctaatcaggcaaagacattcttcactgacaatattccacaggctgctgcacgtgtctcatgtgctgcacgtctcatgcgtctcaaacaagcaatttcaggaatagacagggcacacttccaccggcagagagaagaacagtttattttatattcttaaggcttactgtcctcatacttagaggttcaggatgctggtttgtgtgttacccctgagataaatccttacaagaaataaagtttaggaaatcacccccatgtgtatttcaaggagactctaaatttcaaagagttaaacccaatatattaaagctgaatttctgatattagagacacaatattttagtctacttgatatagttgagaggcagttacctgttttacttaggaacatggggaaagtttgtagtgacaaacagtttgaggcaaaaccaagattatctttaagagcagagatcgatgatatgaagaaaaagaagtggcaactttgactatatgcaggaaacacatttatattgagttgtggggactggcctcagaggaaacttcaggtcatgtcctttaatggccctaaaactcattcccaaaagaatttctgttcattgccatacctcatatccttaggtacatacatctaaaaccctgcgtaccagtgaacagctgccccatctttccatcagccaaccaggaattcagcagttactgctaacttccacttttctctcacccgctccaggaaaagtgacctgcagtcactttcctggaagtattgattctttcttgtttgtggctgttccccatttccaattgttttccatgattattgcttctactgtgatctatagactcttatatcatcaataccaggttatcattgcagttgtcaacttctctctgttgcatcttatgcattaattcaacaaatacatattagattccatatgtcatccatgaagtttcattcatatgccatccatttttcttaattctgagaatcttacatgaactagacagacagattctctggctaatggtgccctcactatagtgagcagaggagaccagcatacatactaaaagaaatgaattaataagagatttcagatggtattatatgacttgaagaaactgcatattgtacctacaaccatctggtcttttagaaacctgacaaaagcaagcaatggggaaaggattttcaatttaataaatgatgggggagaactggctagccatatgctgaaaaatgaaactggactccttccttataccttatccaaaattaactccagatggattagagacttaaatgaaaaaccccaaactataaaaagcctagaaaaaaatcaaggcaatactattcatgatataaacacgggcacagatttcatgatgaaagcgtgaaaagcaattgcagcaaaagcaaaaattgaccaatggaatctaattaaactaaagagctcctgctcagcaaaagaaactaccatcagagcgaaagacaatctacagaatgggaaaaagattttccaatctattcttctgacaaaggcctaatatccagagtaaacaagaaacttaaacaactttacaagaaaaaaaaaacccattaaaaccatggcacacttttacctataaaacaaacctgcatatcctgtacgtgtacccctgaatttaaggtaacagtaaattaaattaaaagaaaaatgccatggcaatgtcagaaagttaccctatatggcctaaaaagagaaggcataaataatccaaaacttgtttaacatatcatcaagaaataaccataaaaggaacaaccagcggccctcggggctgctctgcctatgcagtagtcattcgtttatttctttactctctcaagaaatttgctttgacttaaaaaaaacaaaaaacaaaaaagaaagaaagtgcatattctgaaacggtagtgactgcatttgaagtgggacctttatgatatgatggagccaggcagagatgttggagaagttcctgaaagaaggaagggcatgtgccaaattctgaggctgaggagaaaaaagaaagaaagaaaaaaagaataaagaactttacatttcactgtatgtaaagacattacaaggctagagtaaagcatgttgaagtaaaaataggagaaatcaaagttagagagaagggcgcaggcttattatttgggtcttatagatgagagtagtagagtaggtattttatactgaaacataggggacgaggggagctttgcaaacctgagataaacatggtctgtagtccactcaaaacccaagcttatttttttctccttcttcatctgccttactcagtgcaaggtgctataacaaaatacaaaagactgggtggcttcaacaacagagttttttctcacatttctgaaggctgactcgtggtcagggttctcttcctggattgcagatggcggacttctcactgtgtcctcaccgggaggaaagagaaatggcttgtctctctgcttctgataaggaaaataattttatgatggggatctgctcttatgagctcatctaaacctaattacttttcaaaagcctcccccacagataaggtcagttgggagttggggattcagcatgtgaattttgaggagacacaaacattaggtccgtaacaccatcatattaaactcttacttatagagatgcactaacatccaactatacaaaaattccattaagtaagccttccaattaatgttgtacaaattcttcccactacattttgatctcacagtgctggtctgtttctcagacataacatgctcatgctgacttgtgagcctctgctgattcatttcttacacctaagtccccacctcccccagagtcttacaatgaggtctctcccttgaaatgctgtgaccaatctgcacacttgagggcatgggattaatttcactttcttaggcatccacaagggctgtgaaaagctaagtgccattagaaatagtattcctcctaataaaatagaattgctacacctgactaaaccttgaattcctaaagcttggaacactttcccttccttaagaaccatccttgctactcagctgcaatcaatccagcccccaggtcttcactgaaccttttcccatctcttccaaaacatctgtttctgagaagtcctgtcctatagaggtctttcttcccaccggatttctcctacaccatttactcccacttgcagaactcccgtgtacaagtgtctttactgcttttatttgctcatcaaaatgcacatctcatataaaaataaatgaggagcatgcacacaccacaaacacaaacaggcatgcagaaatacacatacacacttccctcaatataaaccctttgtggctcatatatttaaaaagatgtaaaaaaaagagctgaagaaaatcatgtgtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggcctgtagtttaaagctaaagcatgtaccaatttttgaaaagttcagggattgtgaaatgtgttttaggcataggtccaggatttttgacgggacaaatcttagtctctttcagttagcagtggtttctaaggaaaaagtgctatacttctttttgaatatactctttgtgacttttgccattatctcttaatttctcaatagtgcagtgaaaacaatttctataaagccacagtttcagcgcagtaatagattagtgttacataatataagacctaatgcttacctcaatatctacttatccgtacctatttgaaataaatcatgactgtttcatcttagaaaaatatttgattccatattcaggtatgtatgtatacaccagatgatgtgtatttaccactggataagtgtgtgtgctggctgatgacccagggttttggcgtagctcttctatgctcagtaaagatgatggtagaatgttctttggcaggtactgtggattagaattaattatcttgtataaatgctaggttcacttctcagggaatcttactctaagacataagatgtgcgtgtacatggaaaacaactctaaagaggcaagggttgtttttattgactaatagtccacacactattataactcgaatattagtgtactttagacagctttatttctaacacagtgctgtttctgacatattggaccattaacagggtaggaagtatttatggtggttttttggttctgttttgcttttggttagtttgtttttgtttttctctgaaagtgatccatgatctctaaccttgctagattataatgccagaagctctggaattctggcttatcggaggcaagctgtatcttcaaattagtttatcccctaagctatcaggttgattgaaattattataatattggtgaaattctttcatccttcatgatcctgtgtaaagcttatatctgctcattgatacagatggctaaaaggccagaaagacacacatttacccatgtaacaagcctgcacatcctgcacatgtaccttcgaaattaaaatgaaatgaaataaaattaaaaggaaaaaaatgccatggcaacatcaggaagttatcttttatggtctaaaaatgggcagcataaataatctaccccttgtttagcatactattgaaaaataacaataaaaatcggcaaccagtagcccttgcgtctactctgcctatgaagtagccattcatttattccttcaattttttataaacttgttttactaaaaaaaaaaaggacaaagaaagaaagtgcgaattgtgaaatggtagtgagtgatggcatttgaagtgggtcctttatgatttgatggagccaggcagaagacgtttggagaaagaagttcctgaaagtaggaagggcatgtggaaaactctgaggctgaggaaaaaaaagaaagaaagaaatataaagaaagaacttgacatttcactgtatataaacacattacaagcctaaagtacgttgaagaaaaaatagaattcaaagttagacagaagggctcaggcttactatttgcatcttacagatgagagtagtagagttggtattttattctgaaacacagaggacaagtggagatttgtaaacctgagataaacatggtttctaatccactgaacaccgaagcttatttttttctctttcttcatctgccttacttagtgcaaggtgctataacaaaatagcatagactgggtgacttcaacaacaggattttttctcacttttctgctggttcctggtcagggctctcttcctgggttgcaggtggctgacttcccactgtgtcctcaccagaaggaagagaaatggctaatctctctgcttctgatgaggaaaataattctatgatggggatctgctctcatgagctcctctaaacctgattacttttccaaagcctcccccacaaatggagccaattgggagttggggattcagcatgtgaattttctggagacacaagcgttaagttcataacaccatcacattaaactaaactcttgcttattaacgtgcattaactttcaattatataagaactccagtgaatctgccttctcaattaatgttatacaaattcttcacactatattttcatctgaccgtgctgttctgctgctgagacatgacacgctgatgctgacttgtgagcttctgctggctcatttccttcacctaagtccccacctccctagaagcttacaatgaggtctcctccttgaaatgctgtgaccagtctgtagacttaagggtatgggattaatttcacctctttaggcatgcgtcaacacttaaaatgaaaagttccttagtaaagtaaggatcacttcattgtagttaccgtggaaagaaaaacctgtttcctgctctgatctctaacacctcaacctccctgtagagcctcacaagggctgagaaaagccagatgccgttggaaatagtattgcccctaataaaatagaatggctatccctgcctaaaccttgacttcctaaagcttggaacactttttcttcgttgagccccttcctcgctgctgtgctgcaatccagggaagggggttcagcccccttcactgaacctttccccatctcttccaaaacatctgtttctgaggagtcctgtcctatagaggtctttcttccaaccagatttctcctgcaccttttactcccacttgcagaactcccatgtacaagtttctttattgcctagttcttttatttgctcatcaaaacccacatctaacgtaaacaaaaaagtgtggagtgtgcacatgacacaaacacacatagccatgtataaatacacataaacacatccctcaacataaaaccctttgtggctcatatatttaaaaagacataaaaaaagaactgaagacaaccatgtgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgctttcccattaaatgcaggtagttgttcttcttgcagcactagtcactggccataatttaaatcttgttatcttcttgccaccatgaaccctgtatgctgtaggctgaaaacgttaaaagaaacacacgctctcacacacacacaaacacacgcgcgcacacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaatgaccatacttgtcctgcctccagatagatgttttaaaacgaataacaaaaataggggaaaggtgaaagttctttctaccgaaatctaataaagaaaagtcattttcctcatttccacctctcttttctcaaagtcaaagttgtccatctagattttcagaggcactccttaggccctaaaacattgccactgggtctcagcccagttagtcctctgcagtttcttcactcccaaccccagtatcttcaaacagctcacaccctgctgtgctcagatcaatactcagttgtctaagttgcctcgagactaaaggcaacagtgctgaaacatctcctggactcaccttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctgcttaattttttttatagcctttgccttgttccgattcagtcattccaatttttctctaatttattcttccctttagctagttttcttctcccaccatagaagataccaggacttcttttgtcagccgtttttcaccttcttgtctgtagctccagtgaggcctgtagtttaaagttaaagcatgtaccaatttttgaaaagttcagggattgtgaaatgtgttttaggcataggtccaggatttttgatgggacacgtcttagtctcatttagtaagcattggtttccaaataagaagtgctatacttatctttgaatatactctctgtggttttaggccattatctcttaagttctcattagtgtagtgaaaaatcctataaagcaacagtttcagtgcaggaatagattaatgttatgtaatataatataagactgaatccttacttcaatatctacttatccgtacctatttgaaataaatcacgcctgtttcatctcagcaaaagtattttttttatattcaggtatgtatgtaggcacccgatgatgtgtatttatcactggataagtgtatgtgctggctgatgacccagggttttggtgtagctcttctatgctcggtaaagatgatggtagaatgctctttaccagatactatggattagaattaattatcttgtataaatgctaggttcacttcttagggaatcttattctaagacataagacatgtatttgcatggaaaacaactcttaagaggcagggactgttttattgactaatagtccacacactgtgacagctgggatgtcactgtagtttagacatctttatctgtaactcagtgctgtttctgacatattggccacttaacatggcaggaagtattcatgctgtttttttctttattttttctttgggatttttattttttggtaggtttggttttgcttttgttttttctctgaactcgatccatgaccttggtagattatgacgtcagaaactctggaaatctggcttattggaggagagctctaccttcccctaacctatcaggttgataggaattataataatattggtggaatcctttcagacttcataatcctgtgtaaggcttatatctgctcaaagtgttaggcggctaaaagaccagaaagatacatgttgacctgcgcaacaaagctgcacatattgcacttgttctttggaagttaaaataaaagttgaataagaaaggaaagaaaaagatttgtcaacttatcagtatcttccagttactcacataataataagtgacttctctcaatctaaggatgggtgagaaagatttttattggtatgctggtacagattatagagactgaggtgaacccaaattagggtctctttaagataggggatctgtgagatgggtgtgtatagatctttggccatatctgagagtctggttgggttccatttgtagagcctgacctttaagaatgtgtcagagactggtgtctaagcccgctaaggcctaaacaagtgaatcttttgaatctctcttttttttttttgagacagagtcttgttctgtcacccaggctggagtgcagtggtatgatctcggctcactgcaactcctgccttccaggttcaagcaattctccttcctcagcctcccaagtagctgggattacaggcacttgccatcatgcctgtctaatttttgtatttttgtagagatgggatttcaccatgttggccaggttggtcttgaactcttgacctcaggtgatctgcctgccttggcctcccaaaattctgggattacaggcgtgagccaccactcccagcctctaaacaagtgaatcttaattgctcctcctcagactaaggaatatctaggatccctcctgttttcaaacaacttccccatttatccaaaaaccaaggcagtgttctaaaagtcatgtataaacccttatttcctcttatgcttttgaggcaatatcttttaagagtttgttgatttctccttatccataactgtcttattcctcgatttttcctatatcattgcttctgacattgattaaatcctaactgataaaactgtttctttacacaagcaatttcaagtgttttcaagcattctttcccatgtattttcaaacatttgttcagcaaatatctgttaaataaatgtcataatttttaaagtagtgggcatttaagttaaataagtcagagaataaaactttcctctgaagattataatctaggtagaacatacataaaattaataattaagttaaacaacaaaataatttcagatattattaactaagaatgaaattaaggagaaagtattcgaacagaggcaaaatgacagaaggaatctgccatgggaaggcattgccaaataaagtttagaagctgaaatagtaaattcaaagctctgaagcagaagaaaacaaactcctgctgtgccagagagttagataaagaaccagtgccgttgatatgtaaagtggagaatagcaggtggtattgtttcagggaagcataaacctaaggacataaacttgtcctcagtggtagggagtgagaagccattatagaattttaactctggtaatgacataatctctaagcaacctgtactattggctggattactattctaagaatgacctgtttatcacaactgttttgcttaaaaagcccttattgcctgtggacaattattagttattctttcaactattaaaaatcttgtcatgcagatgtgtgtgtgtgtgtgtgtattcattatgaatttgctttcaattaagttatcttgaattggcaatatctaaatctagatatagctccctaaggggtaaagagtgtatccactgcccacccctcaacatcacgtccttgattccttgatatcaaagggcagtatagttttgggggagaagaaaaagagagagagagaaaaaaagattgattaaaaatgcatattaccgacaaattagagggtgatggcagatgggaggcagcagaagtacattgcagctcccactcggatgcacagagcagcatgtgaagtctcccatcaggaattttttttgcagaaccacctgcagaaataaatcaagaaagctgagagaacgcacacaccctctgaaagaagcagattgctcctgcaggacccgggaaacaccccaaatattgtgagtgcccaaactgtggaagtggaaaagggggaccgtctacccccaaacacacatcctcactggggaacctgaagatctagaccacaggagaagattctgaccttacctggagctgagtcaatttagagggccaagcaaaatacaggggtagaggaagcagcgggaaaagccctgtgggctctctgggtcccctaggaagccatttctgccttgcctcacaggggtcatttgggagggctgccagaggaactgggaaaagatgacaggaaaaagaaaatctccacctggccagatctaggggctgggcagtgggggggttggtggggggacatgaatttggtgtgcagactccactggcagggaagtaggacagccctacttggtttcgcagctggtagcctggggcaagttctcagccttgctcactgactgcatggaaacagattcggtgctgttgcgggggagggtgcacgctggaagtgagaccaaccttttgagttgcatgggagctgggcaagtcacgtgactgcttgctttcccccactttcctgatgacctgcatgacacagcagaggcagccataattgtcctaggaacataaatccattgacctggaaactacacccccatcctcccacagtagccacagaaagacctgcccaaggagactctgagctcagacacgactagtcctgcccccacctgatggtccttccttactcaccctggtagctgaagacaaagggcatatattcttgggagttctagggtgccccagcccccccagccaccaccacctgactgcctctgctgatgctttctagaaagtgccacctcctggcaggaggccaaccagcacaaaaatagtgcattgaacaaccaaaagtaaggaccctcacagagtccatttcatcctctgccacctccattggagcaggtggttgtatctatggctgagagacccacagatggttcacgtcacaagactctgtgcagacaaaccccagtaccagcctggagtctggtagacctgatgggtggctagatccagaagagagataacaatcactacagttcggctctcaggaagccccacgcctaggaaaagggggactgtgctacatcaagggaacacctcatgggacaaaagtctcagccttgaggcctagactttccctctgacagagcctacccaagtgagaaggaaccagaaaactaactctggtaatatgaaaaacaaggttctttaacaccccccaaaaaatcatactagctcaccagcaatgcatccaaaccaagaagaaatccctgatttacctgaaaaataattcagaaggtcagttattaagctaatcaaggaggcatccgaggaaggtgaagtccaattttaaaaaaaccaaaaatatgatacaagaaatgaggggagaaatcttcagttaaagagatagcataaataaaaaacattcaaaacttcaggaaacaatggatgaatggatgcacttatagaaatgcaaaatgctctagaaagtctcagcaatagaatccaagcagaagaaattcagagcttgaagacaaagtttttgaattaacccaatccaacaaagacaaagaaaaaagaataagaaaatatgaacaaagcctccaagaaatctgggattatgttaaacaatcaaacctaagaataatcagcattcctgagaaagaagagaaatctaaaagtttggaaaacttatccagggaaataatcaaggaaaacttcccccaccttgctagagacctagatatccaaatacaagaagctcaataaacacctgggaaattcattgcaaaaatatcattgcctaggtacattgtcatcagagtatccaaagttatctaaagacaaagagaatcttaagagctgtgaggtgaaactaccaggtaacctatgaaagaaaacctatcagattaacagcagatttctcagcagaaaccgtaaaagctagaagtgaatatggccctatcttcagccttcttaaacaaaacaattatcagccaagaattttatatccagtgaaactaagcttcacaaatgaagaaaatacacagtgtttttcagaaaaacaaatgctgagagaattcggcactaccaagccaacactacaagaactgataaaaggagctctaaatcttgaaataaaccctggaagcacatcaaaacagaacctctttaaagcataaatcccataggacatatacaacaaaaatacagataaaaagatacacaggcaacaaataccacgaagaatggaatagtacctcacacctcaatactgatgttgaatgtaaatggactaaatgctccacttaaaagatacagaattgcagaatgaataagaattcaccaaccagttatctgccgccttcaggagactcacctaacacataaggactcacataaacttaaggtaaaggggtggaaaatgacattccacacaaatggacaccaaaagcgagccaaagcagctattcttatgtcagacaaaacaaactttaaagaaacagcagttaaaaaagacaaagagggacatcatataatgataaaagcccttgtccaatgggagaatattacaattcttaatatatatgcatctaatactggagatcccaaatttataaaacaattactactagactagacagcaacataataatagtgggggacttcaatactccactgactgcactaggcaggtcatcaagacagtctacaaagaaacaatggatttaaagaacaaatggacttaacagatatttacaggacattctacccaacaactgcagaatacacattctattcatcagcacatggaactttctccaagataggccatatgatatgccacaaaacaagcctcaataaatttttaaaaattgaaattatatcaagcactctctcagaccacagtagaataaaattggaaatcaactacaaaaggaaccttcaaaaccatgcaaatacagggaaattaaataacctgctcctgaatgatcattgggtcaacaatgaaatcaagatggaaatttaaaaatcatttgctttgaaaaccggcacaagacaaggatgccctctcgccactcttactcaacatagtattggaagttctcgccaggacaatcaggcaagagaaagaaataaagcatattcaaataggaagagaggaagtcaaattgtctctgtttgcagatgacatgattgtatatttagaagaccctgtcatctcagcccaaaatcttaagctgataaacagcttcagcaaagtctcaagatacaaaatcagtgtgcagaaatcacaagcgttcctatacaccaataatagacaagcagagagccaaatcatgggtgaactcccattcacaattgctgcaaagagaataaaataaaatacctagaaatacaacttctaagggatgtgaagaacctcttcaaggagagctacaaaccactcactgctcaaggaaataagagaggacacaaacaaatggaaaaacattccatgctcatagatagaaagaatcaatatctttaaaatggccatactgcccaaagtaatttatagattcaatgctatccccatcaagctaccactgacttttt

SEQ ID NO: 9 - DNA, 25591 bp, Homo sapiens
atatttatggggtacatgtgatacttacatgcctagaacatgtgatgattaagtctagatatttaggatatccattgctttgagcatttatcatttctatgtattgagaaaatttcaaatcctcatttctagccattttgaaatatataataaatagtaattaactatagtcaccctactcaaatatcaaacattatggcttaatccttctatccaactgtgtttgtacctattaaccaacatctcttaaatcccctcccatacacactcacactttttccagcctctgataactatcattctactctctaccaccatgagacccacttttttagctcccacagatgaataaaaacatgtgatatttgactttctgtatctggcttattttattatctatctctttggcataccaagagtttgtttttgttctgcttcagggctttcaattaacataatgacctctggttccatccatgttgctacaaatgacaagatttcattctttttcatggcaaaatagtactgtgcaaaaatacaattttttaatccgttcatctgttgatagacacttaggttgatcccaaaccttaactattgtgaatagtgcttcaataaacatgagtgtaatgtgtccattggatatactgatttcctttcttttggataaataaccactagtgagattgctggattgtatgatagttctgtttttagtttactgagaaatcttcatactgttttccataatggttgtactattttacattcccaccaacagtgtgtaagaaagagttcccttttctccatatcctcacaaggatctgttattttttgtcttttttgttaatagccgttttaactagagtaagtagatatctcattgtagttttgatttgcatttccctgatcattagtgatgttgagaattttttcatatgtttgttggtcatttgtatatctttttctgagaattgtctgttcatgtccttagcctactttttattgggattgtttgttattttcttgataatctatttgtgttcattttagagcctggatattattcttttgtcagatgtatagattgtgaagattttctcccactctgtgggttgtctgtttattctgcagactcttccttttgccatgcaaaagctctttagtttaatttagtcccagatattttctttgtttttatgtatttgcatttgtgttcttggtcatgaaatcctttcctaagccaatgtgtagaagggtttttccgatgttattttctagaattgttacagtttcagggcttagatttaagtccttgatccatcttgagttgatttttgtataaggtgagagatgaagatccagtttcattctcctacatgtagcttgccagctatccccgcaccatttgttgaatagggtgccctttccccactttatgtttttgtttgctttgtcaaagatcagttggatgtaagtatttgagtttatttctgggttctctattctgttccattggtcgatgtgcctatttgtacaccagcatcatgctgttttggtgactatggccttattgtatagtttgaaatgaggtaatgtaatgccttcagatttgttcttttttttagacttgcttgtttattgggctcttttttggttccataagaattttaggattgttttttctagttctgtgaagactaatggtggtattttgatgggaattgcaatgaatttgtaggttgcttctggcattatggccattttcacaatattgattctacccatctatgagaatggcatgtgtttccatttgtttgtgtcttatatgattactttcagccgtgttttgtagttttccttgtagatgtctttcacctccttggttaggtatatattcctaagtttttgttttgttttgttttgttttttgcagctattgtaaaaggggttgagttcttgattttattctcagcttggtcattgctggtatgtaagaaagcaactcattggtgtacgttaattttgtatccagaaactttgctgaattattttatcagttctagggggttttggaggagtctttagagttttctacatacacaatcatatcatcagcaaacagtgacagtttgactttctctttaacaatttggatgtgctttacttgtttctcttgtctgattgctcttgctaggacttccagtaatatgttaaagagaagtggtgagagtgggtatccttgtctcattccagttttcagacagaatgcttttaactttttcccattcaatataatgttggctgtgtgtttaccatagctggcttttattacattgaggtatgtcctttgtaaaccgattttgctgagttttagtcataaagtgatgttgaattttgttgaatgcagtttctgtggctattgagataatcacatgatttttgtttccaattctctttatgttgtgtatcacacttattgacttgcgtatgttaaaccatccgtgcatccctcgcatgaaacccacttgatcatgggttttgatatgctgtcggatgctattagctagtattttgtcaaggatgttggcatctatgttcatcagggatattgatctgtagtgttttttttttttggttatgttctttcccagttttggtattaaggtgatactggcttcatagaatgatttagggaggattctctctttctctatcttgtagaatactgtcaataggattggtatcaattcttctttgaatgtctggtagaattcagctgtgaatctatctggtcctggacttttttgttgttggtaaatttttattatcatttcagtcttgctgcttattactggtctgttcagggtatctaattcttcctgacttaagctagagccctgtatctttccaggaattcgaacgtctcctttaggttttctagtttatgcatgtaaaggtgttcatagtagccttgaataatcttttgtatttctgtggtatcagtaatagtatctcctgttttgtttctaattgagtttatttgcacttctctcctcttttcttggttaatcttgctaatggtctatcagttttatttatcttttcaaagaaccagctttttatttcatttagcttttgtatttttttgcagttgttttaatttcatttagttctcctcttatcttagttattccctttcttttgctgggttttggttctgtttgtttttgtttctctagtttcttgtggtgtgaccttatattgtctgtctgtcctctttcagactctttgacatcgacatttagggctgtgaactttccttttagcaccatctttgctgtatcctagaggttttgataggttgtgtcactattgtcggtcagttcaagtaattttgttgttcttattatactttaagttctgggatacatgtgcagaatgtgcaggtttgttacataggtatagatgtgccatggtggtttgctgcacccatcaacctgtcatctacattaggtatttcttttaatgttatccctctcctaaccccctcaccccccgacaggccctggtgtgtgatgttcccctccctgtgtccatgtgttctcattgttcaactcccacttatgagtgagaacgtgtggtgtttggtttctctgttcctgtgttagtttgctcagaatgatggtttccaccttcatccatgtccctgcaaagacatgaactcatcatttttatggctgcatagtattccatggtgtatatgtgccacattttctttatccattatatcgctgatggccatttgggttggttccaagtctttgctattgtgaatagtgccacaataaacatacgtgtgcacgtgtctttatagtagaatgatttctaattctttgggtatatacccagtaatgggattgctgggtcaaacagtatttctggttctagatccttgaggaatcgccacactgtcttccacaatggttgaactaatttacacacccatcaacagtgtaaaatttttcctattcttccacatcctctccagcaccttttgtttcctgactttttaataattgccattctaactggcatgagatggtatctcattgtggttttgatttgcatttctctaatgaccagtgatgatgagcttcttttcatgtgtttcttggccacataaatgacttctttagagaagcatctgttcatatcctttgtccactttttgatggggtcgttaggttttttcttgtaaatttgttgaagttctttgtagattttggatgttagccctttgtcagatggatagattgcaaaaattttctcccattctgtaggttgcctgttcactctgatgatagtcttttgctgtgcagaagctctttagtttaattagatcccatatgtcaattttggcctttgttgtcattgcttttgatgttttagtcgtgaatttttgcccatgcctatgtcctgaatggtattgcctaggttatcttctaggatttttatggttttaggttgcacatttaagtctttaatccaccttgagttaatttttgtataaggtgtaaggaaggggtacagtttcagttttatgcatattgctagccagtttttccagcaccatttattaaatagggaattctttctccattgcttttgtgatgtttgtcaaagatcagatggtcgtagatgtgtggcattatttctgaggcttctgttctgttccactggtctatatatctgttttggtaccagtaccatgctgtttttgttactgtagccttgtagtatagtttgaagtcaggtagcatcatgcctccagctttgttctttttgtttaggattgtcttggctatatgggctcttttttgattccatatgacatttaaagtagttttttctaattctttgaaaaaagtcagtggtagcttgatggggatagcattgaatctataaattactttgggcagtatggccattttaaagatattgattctttctatctatgagcatggaatgtttttccatttgtttgtgtcctctcttatttccttgagcagtgagtggtttgtagctctccttgaagaggttcttcacatcccttagaagttgtatttctaggtattttattttattctctttgcagcaattgtgaatgggagttcacccatgatttggctctctgcttgtctattattggtgtataggaacgcttgtgatttctgcacactgattttgtatcttgagactttgctgaagctgtttatcagcttaagattttgggctgagatgacagggtcttctaaatatacaatcatgtcatctgcaaacagagacaatttgacttcctctcttcctatttgaatatgctttatttctttctcttgcctgattgtcctggcgagaacttccaatactatgttgagtaagagtggcgagagggcatccttgtcttgtgccggttttcaaagcaaatgatttttaaatttccatcttgatttcattgttgacccaatgatcattcaggagcaggttatttaatttccctgtatttgcatggttttgaaggttccttttgtagttgatttccaattttattctactgtggtctgagagagtgcttgatataatttcaatttttaaaaatttattgaggcttgttttgtggcatatcatatggcctatcttggagaaagttccatgtgctgatgaatagaatgtgtattctgcagttgttgggtagaatgtcctgtaaatatctgttaagtccatttgttctttaaatccattgtttctttgtagactgtcttgatgacctgcctagtgcagtcagtggagtattgaagtcccccactattattatgttgctgtctagtctagtagtaattgttttataaatttgggatctccagtattagatgcatatatattaagaattgtaatattctcccattggacaagggcttttatcattatatgatgtccctctttgtcttttttaactgctgtttctttaaagtttgttttgtctgacataagaatagctgctttggctcgcttttggtgtccatttgtgtggaatgtcattttccacccctttaccttaagtttatgtgagtccttatgtgttaggtgagtctcctgaaggcggcagataactggttggtgaattcttattcattctgcaattctgtatcttttaagtggagcatttagtccatttacattcaacatcagtattgaggtgtgaggtactattccattcttcgtggtatttgttgcctgtgtatctttttatctgtatttttgttgtatatgtcctatgggatttatgctttaaagaggttctgttttgatgtgcttccagggtttatttcaagatttagagctccttttatcagttcttgtagtgttggcttggtagtgccgaattctctcagcatttgtttttctgaaaaacactgtgtattttcttcatttgtgaagcttagtttcactggatataaaattcttggctgataattgttttgtttaagaaggctgaagatagggccatattcacttctagcttttacggtttctgctgagaaatctgctgttaatctgataggttttctttcataggttacctggtagtttcacctcacagctcttaagattctctttgtctttagataactttggatactctgatgacaatgtacctaggcaatgatatttttgcaatgaatttcccaggtgtttattgagcttcttgtatttggatatctaggtctctagcaaggtgggggaagttttccttgattatttccctggataagttttccaaacttttagatttctcttctttctcaggaatgctgattattcttaggtttgattgtttaacataatcccagatttcttggaggctttgttcatattttcttattcttttttctttgtctttgttggattgggttaattcaaaaactttgtcttcaagctctgaatttcttctgcttggattctattgctgagactttctagagcattttgcatttctataagtgcatccattcatccattgtttcctgaagttttgaatgttttttatttatgctatctctttaactgaagatttctcccctcatttcttgtatcatatttttggtttttttaaaattggacttcaccttcctcggatgcctccttgattagcttaataactgaccttctgaattatttttcaggtaaatcagggatttcttcttggtttggatgcattgctggtgagctagtatgattttttggggggtgttaaagaaccttgtttttcatattaccagagttagttttctggttccttctcacttgggtaggctctgtcagagggaaagtctaggcctcaaggctgagacttttgtcccatgaggtgttcccttgatgtagcacagtcccccttttcctaggcgtggggcttcctgagagccgaactgtagtgattgttatctctcttctggatctagccacccatcaggtctaccagactccaggctggtactggggtttgtctgcacagagtcttgtgacgtgaaccatctgtgggtctctcagccatagatacaaccacctgctccaatggaggtggcagaggatgaaatggactctgtgagggtccttacttttggttgttcaatgcactatttttgtgctggttggcctcctgccaggaggtggcactttctagaaagcatcagcagaggcagtcaggtggtggtggctgggggggctggggcaccctagaactcccaagaatatatgccctttgtcttcagctaccagggtgagtaaggaaggaccatcaggtgggggcaggactagtcgtgtctgagctcagagtctccttgggcaggtctttctgtggctactgtgggaggatgggggtgtagtttccaggtcaatggatttatgttcctaggacaattatggctgcctctgctgtgtcatgcaggtcatcaggaaagtgggggaaagcaagcagtcacgtgacttgcccagctcccatgcaactcaaaaggttggtctcacttccagcgtgcaccctcccccgcaacagcaccgaatctgtttccatgcagtcagtgagcaaggctgagaacttgccccaggctaccagctgcgaaaccaagtagggctgtcctacttccctgccagtggagtctgcacaccaaattcatgtccccccaccaacccccccactgcccagcccctagatctggccaggtggagattttctttttcctgtcatcttttcccagttcctctggcagccctcccaaatgacccctgtgaggcaaggcagaaatggcttcctaggggacccagagagcccacagggcttttcccgctgcttcctctacccctgtattttgcttggccctctaaattgactcagctccaggtaaggtcagaatcttctcctgtggtctagatcttcaggttccccagtgaggatgtgtgtttgggggtagacggtcccccttttccacttccacagtttgggcactcacaatatttggggtgtttcccgggtcctgcaggagcaatctgcttctttcagagggtgtgtgcgttctctcagctttcttgatttatttctgcaggtggttctgcaaaaaaaattcctgatgggagacttcacatgctgctctgtgcatccgagtgggagctgcaatgtacttctgctgcctcccatctgccatcaccctctaatttgtcggtaatatgcatttttaatcaatctttttttctctctctctctttttcttctcccccaaaactatactgccctttgatatcaaggaatcaaggacgtgatgttgaggggtgggcagtggatacactctttaccccttagggagctatatctagatttagatattgccaattcaagataacttaattgaaagcaaattcataatgaatacacacacacacacacacatctgcatgacaagatttttaatagttgaaagaataactaataattgtccacaggcaataagggctttttaagcaaaacagttgtgataaacaggtcattcttagaatagtaatccagccaatagtacaggttgcttagagattatgtcattaccagagttaaaattctataatggcttctcactccctaccactgaggacaagtttatgtccttaggtttatgcttccctgaaacaataccacctgctattctccactttacatatcaacggcactggttctttatctaactctctggcacagcaggagtttgttttcttctgcttcagagctttgaatttactatttcagcttctaaactttatttggcaatgccttcccatggcagattccttctgtcattttgcctctgttcgaatactttctccttaatttcattcttagttaataatatctgaaattattttgttgtttaacttaattattaattttatgtatgttctacctagattataatcttcagaggaaagttttattctctgacttatttaacttaaatgcccactactttaaaaattatgacatttatttaacagatatttgctgaacaaatgtttgaaaatacatgggaaagaatgcttgaaaacacttgaaattgcttgtgtaaagaaacagttttatcagttaggatttaatcaatgtcagaagcaatgatataggaaaaatcgaggaataagacagttatggataaggagaaatcaacaaactcttaaaagatattgcctcaaaagcataagaggaaataagggtttatacatgacttttagaacactgccttggtttttggataaatggggaagttgtttgaaaacaggagggatcctagatattccttagtctgaggaggagcaattaagattcacttgtttagaggctgggagtggtggctcacgcctgtaatcccagaattttgggaggccaaggcaggcagatcacctgaggtcaagagttcaagaccaacctggccaacatggtgaaatcccatctctacaaaaatacaaaaattagacaggcatgatggcaagtgcctgtaatcccagctacttgggaggctgaggaaggagaattgcttgaacctggaaggcaggagttgcagtgagccgagatcataccactgcactccagcctgggtgacagaacaagactctgtctcaaaaaaaaaaaagagagattcaaaagattcacttgtttaggccttagcgggcttagacaccagtctctgacacattcttaaaggtcaggctctacaaatggaacccaaccagactctcagatatggccaaagatctatacacacccatctcacagatcccctatcttaaagagaccctaatttgggttcacctcagtctctataatctgtaccagcataccaataaaaatctttctcacccatccttagattgagagaagtcacttattattatgtgagtaactggaagatactgataagttgacaaatctttttctttcctttcttattcaacttttattttaacttccaaagaacaagtgcaatatgtgcagctttgttgcgcaggtcaacatgtatctttctggtcttttagccgcctaacactttgagcagatataagccttacacaggattatgaagtctgaaaggattccaccaatattattataattcctatcaacctgataggttaggggaaggtagagctctcctccaataagccagatttccagagtttctgacgtcataatctaccaaggtcatggatcgagttcagagaaaaaacaaaagcaaaaccaaacctaccaaaaaataaaaatcccaaagaaaaaataaagaaaaaaacagcatgaatacttcctgccatgttaagtggccaatatgtcagaaacagcactgagttacagataaagatgtctaaactacagtgacatcccagctgtcacagtgtgtggactattagtcaataaaacagtccctgcctcttaagagttgttttccatgcaaatacatgtcttatgtcttagaataagattccctaagaagtgaacctagcatttatacaagataattaattctaatccatagtatctggtaaagagcattctaccatcatctttaccgagcatagaagagctacaccaaaaccctgggtcatcagccagcacatacacttatccagtgataaatacacatcatcgggtgcctacatacatacctgaatataaaaaaaatacttttgctgagatgaaacaggcgtgatttatttcaaataggtacggataagtagatattgaagtaaggattcagtcttatattatattacataacattaatctattcctgcactgaaactgttgctttataggatttttcactacactaatgagaacttaagagataatggcctaaaaccacagagagtatattcaaagataagtatagcacttcttatttggaaaccaatgcttactaaatgagactaagacgtgtcccatcaaaaatcctggacctatgcctaaaacacatttcacaatccctgaacttttcaaaaattggtacatgctttaactttaaactacaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggcaatgttttagggcctaaggagtgcctctgaaaatctagatggacaactttgactttgagaaaagagaggtggaaatgaggaaaatgacttttctttattagatttcggtagaaagaactttcacctttcccctatttttgttattcgttttaaaacatctatctggaggcaggacaagtatggtcattaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgcgcgcgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcacacatggttgtcttcagttctttttttatgtctttttaaatatatgagccacaaagggttttatgttgagggatgtgtttatgtgtatttatacatggctatgtgtgtttgtgtcatgtgcacactccacacttttttgtttacgttagatgtgggttttgatgagcaaataaaagaactaggcaataaagaaacttgtacatgggagttctgcaagtgggagtaaaaggtgcaggagaaatctggttggaagaaagacctctataggacaggactcctcagaaacagatgttttggaagagatggggaaaggttcagtgaagggggctgaacccccttccctggattgcagcacagcagcgaggaaggggctcaacgaagaaaaagtgttccaagctttaggaagtcaaggtttaggcagggatagccattctattttattaggggcaatactatttccaacggcatctggcttttctcagcccttgtgaggctctacagggaggttgaggtgttagagatcagagcaggaaacaggtttttctttccacggtaactacaatgaagtgatccttactttactaaggaacttttcattttaagtgttgacgcatgcctaaagaggtgaaattaatcccatacccttaagtctacagactggtcacagcatttcaaggaggagacctcattgtaagcttctagggaggtggggacttaggtgaaggaaatgagccagcagaagctcacaagtcagcatcagcgtgtcatgtctcagcagcagaacagcacggtcagatgaaaatatagtgtgaagaatttgtataacattaattgagaaggcagattcactggagttcttatataattgaaagttaatgcacgttaataagcaagagtttagtttaatgtgatggtgttatgaacttaacgcttgtgtctccagaaaattcacatgctgaatccccaactcccaattggctccatttgtgggggaggctttggaaaagtaatcaggtttagaggagctcatgagagcagatccccatcatagaattattttcctcatcagaagcagagagattagccatttctcttccttctggtgaggacacagtgggaagtcagccacctgcaacccaggaagagagccctgaccaggaaccagcagaaaagtgagaaaaaatcctgttgttgaagtcacccagtctatgctattttgttatagcaccttgcactaagtaaggcagatgaagaaagagaaaaaaataagcttcggtgttcagtggattagaaaccatgtttatctcaggtttacaaatctccacttgtcctctgtgtttcagaataaaataccaactctactactctcatctgtaagatgcaaatagtaagcctgagcccttctgtctaactttgaattctattttttcttcaacgtactttaggcttgtaatgtgtttatatacagtgaaatgtcaagttctttctttatatttctttctttcttttttttcctcagcctcagagttttccacatgcccttcctactttcaggaacttctttctccaaacgtcttctgcctggctccatcaaatcataaaggacccacttcaaatgccatcactcactaccatttcacaattcgcactttctttctttgtcctttttttttttagtaaaacaagtttataaaaaattgaaggaataaatgaatggctacttcataggcagagtagacgcaagggctactggttgccgatttttattgttatttttcaatagtatgctaaacaaggggtagattatttatgctgcccatttttagaccataaaagataacttcctgatgttgccatggcatttttttccttttaattttatttcatttcattttaatttcgaaggtacatgtgcaggatgtgcaggcttgttacatgggtaaatgtgtgtctttctggccttttagccatctgtatcaatgagcagatataagctttacacaggatcatgaaggatgaaagaatttcaccaatattataataatttcaatcaacctgatagcttaggggataaactaatttgaagatacagcttgcctccgataagccagaattccagagcttctggcattataatctagcaaggttagagatcatggatcactttcagagaaaaacaaaaacaaactaaccaaaagcaaaacagaaccaaaaaaccaccataaatacttcctaccctgttaatggtccaatatgtcagaaacagcactgtgttagaaataaagctgtctaaagtacactaatattcgagttataatagtgtgtggactattagtcaataaaaacaacccttgcctctttagagttgttttccatgtacacgcacatcttatgtcttagagtaagattccctgagaagtgaacctagcatttatacaagataattaattctaatccacagtacctgccaaagaacattctaccatcatctttactgagcatagaagagctacgccaaaaccctgggtcatcagccagcacacacacttatccagtggtaaatacacatcatctggtgtatacatacatacctgaatatggaatcaaatatttttctaagatgaaacagtcatgatttatttcaaataggtacggataagtagatattgaggtaagcattaggtcttatattatgtaacactaatctattactgcgctgaaactgtggctttatagaaattgttttcactgcactattgagaaattaagagataatggcaaaagtcacaaagagtatattcaaaaagaagtatagcactttttccttagaaaccactgctaactgaaagagactaagatttgtcccgtcaaaaatcctggacctatgcctaaaacacatttcacaatccctgaacttttcaaaaattggtacatgctttagctttaaactacaggcctcactggagctagagacaagaaggtaaaaaacggctgacaaaagaagtcctggtatcctctatgatgggagaaggaaactagctaaagggaagaataaattagagaaaaactggaatgactgaatcggaacaaggcaaaggctataaaaaaaattagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaaggtgagtccaggagatgtttcagccctgttgcctttagtctcgaggcaacttagacaacggagtattgatctgagcacagcagggtgtgagctgtttgaagatactggggttgggggtgaagaaactgcagaggactaactgggctgagacccagtggtaatgttttagggcctaaggagtgcctctaaaaatctagatggacaattttgactttgagaaaagagaggtggaaatgaggaaaatgacttttctttattagattccagtagaaagaactttcatctttccctcatttttgttgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgcgcgcgcgcgtgtgtgtgtgtgtgtcagcgtgtgtttcttttaacgtcttcagcctacaacatacagggttcatggtggcaagaagatagcaagatttaaattatggccagtgactagtgcttgaaggggaacaactacctgcatttaatgggaaggcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgtacacgggagttctgcaagtgggagtaaatggtgtaggagaaatccggtgggaagaaagacctctataggacaggacttctcagaaacagatgttttggaagagatgggaaaaggttcagtgaagacctgggggctggattgattgcagctgagtagcaaggatggttcttaaggaagggaaagtgttccaagctttaggaattcaaggtttagtcaggtgtagcaattctattttattaggaggaatactatttctaatggcacttagcttttcacagcccttgtggatgcctaagaaagtgaaattaatcccatgccctcaagtgtgcagattggtcacagcatttcaagggagagacctcattgtaagactctgggggaggtggggacttaggtgtaagaaatgaatcagcagaggctcacaagtcagcatgagcatgttatgtctgagaaacagaccagcactgtgagatcaaaatgtagtgggaagaatttgtacaacattaattggaaggcttacttaatggaatttttgtatagttggatgttagtgcatctctataagtaagagtttaatatgatggtgttacggacctaatgtttgtgtctcctcaaaattcacatgctgaatccccaactcccaactgaccttatctgtgggggaggcttttgaaaagtaattaggtttagatgagctcataagagcagatccccatcataaaattattttccttatcagaagcagagagacaagccatttctctttcctcccggtgaggacacagtgagaagtccgccatctgcaatccaggaagagaaccctgaccacgagtcagccttcagaaatgtgagaaaaaactctgttgttgaagccacccagtcttttgtattttgttatagcaccttgcactgagtaaggcagatgaagaaggagaaaaaaataagcttgggttttgagtggactacagaccatgtttatctcaggtttgcaaagctcccctcgtcccctatgtttcagtataaaatacctactctactactctcatctataagacccaaataataagcctgcgcccttctctctaactttgatttctcctatttttacttcaacatgctttactctagccttgtaatgtctttacatacagtgaaatgtaaagttctttattctttttttctttctttcttttttctcctcagcctcagaatttggcacatgcccttccttctttcaggaacttctccaacatctctgcctggctccatcatatcataaaggtcccacttcaaatgcagtcactaccgtttcagaatatgcactttctttcttttttgttttttgttttttttaagtcaaagcaaatttcttgagagagtaaagaaataaacgaatgactactgcataggcagagcagccccgagggccgctggttgttccttttatggttatttcttgatgatatgttaaacaagttttggattatttatgccttctctttttaggccatatagggtaactttctgacattgccatggcatttttcttttaatttaatttactgttaccttaaattcaggggtacacgtacaggatatgcaggtttgttttataggtaaaagtgtgccatggttttaatgggttttttttttcttgtaaagttgtttaagtttcttgtttactctggatattaggcctttgtcagaagaatagattggaaaatctttttcccattctgtagattgtctttcgctctgatggtagtttcttttgctgagcaggagctctttagtttaattagattccattggtcaatttttgcttttgctgcaattgcttttcacgctttcatcatgaaatctgtgcccgtgtttatatcatgaatagtattgccttgatttttttctaggctttttatagtttggggtttttcatttaagtctctaatccatctggagttaattttggataaggtataaggaaggagtccagtttcatttttcagcatatggctagccagttctcccccatcatttattaaattgaaaatcctttccccattgcttgcttttgtcaggtttctaaaagaccagatggttgtaggtacaatatgcagtttcttcaagtcatataataccatctgaaatctcttattaattcatttcttttagtatgtatgctggtctcctctgctcactatagtgagggcaccattagccagagaatctgtctgtctagttcatgtaagattctcagaattaagaaaaatggatggcatatgaatgaaacttcatggatgacatatggaatctaatatgtatttgttgaattaatgcataagatgcaacagagagaagttgacaactgcaatgataacctggtattgatgatataagagtctatagatcacagtagaagcaataatcatggaaaacaattggaaatggggaacagccacaaacaagaaagaatcaatacttccaggaaagtgactgcaggtcacttttcctggagcgggtgagagaaaagtggaagttagcagtaactgctgaattcctggttggctgatggaaagatggggcagctgttcactggtacgcagggttttagatgtatgtacctaaggatatgaggtatggcaatgaacagaaattcttttgggaatgagttttagggccattaaaggacatgacctgaagtttcctctgaggccagtccccacaactcaatataaatgtgtttcctgcatatagtcaaagttgccacttctttttcttcatatcatcgatctctgctcttaaagataatcttggttttgcctcaaactgtttgtcactacaaactttccccatgttcctaagtaaaacaggtaactgcctctcaactatatcaagtagactaaaatattgtgtctctaatatcagaaattcagctttaatatattgggtttaactctttgaaatttagagtctccttgaaatacacatgggggtgatttcctaaactttatttcttgtaaggatttatctcaggggtaacacacaaaccagcatcctgaacctctaagtatgaggacagtaagccttaagaatataaaataaactgttcttctctctgccggtggaagtgtgccctgtctattcctgaaattgcttgtttgagacgcatgagacgtgcagcacatgagacacgtgcagcagcctgtggaatattgtcagtgaagaatgtctttgcctgattagatataaagacaagttaaacacagcattagactatagatcaagcctgtgccagacacaaatgacctaatgcccagcacgggccacggaatctcctatcctcttgcttgaacagagcagcacacttctcccccaacactattagatgttctggcataattttgtagatatgtaggatttgacatggactattgttcaatgattcagaggaaatctcctttgttcagataagtacactgactactaaatggattaaaaaacacagtaataaaacccagttttccccttacttccctagtttgtttcttattctgctttcttccaagttgatgctggatagaggtgtttatttctattctaaaaagtgatgaaattggccgggcgcggtggctcacacctgtaatcccagcactttgggaggctgaggtgggcggatcacgaggtcaggagatcaagaccatcctggctaacatggtgaaaccccatctctactaaaaatacaaaaaattagccagagacagtggcgggtgcctgtagtcccagctactcgggaggctgaggcaggagaatggcgtgaacctgggaggcagagcttgcggtgagcagagatcgcgccactgcacactccagcctgggtgacaaagcgagactccatctcaaaaaaaaaaaaaaaaaaaagaaaaagaaagaaagaaagaaaaaaaaactgatgaaattgtgtattcaatgtagtctcaagagaattgaaaaccaagaaaggctgtggcttcttccacataaagcctggatgaataacaggataacacgttgttacattgtcacaactcctgatccaggaattgatggctaagatattcgtaattcttatccttttcagttgtaacttattcctatttgtcagcattcaggttattagcggctgctggcgaagtccttgagaaataaactgcacactggatggtgggggtagtgtaggaaaatggaggggaaggaagtaaagtttcaaattaagcctgaacagcaaagttcccctgagaaggccacctggattctatcagaaactcgaatgtccatcttgcaaaacttccttgcccaaaccccacccctggagtcacaacccacccttgaccaatagattcattttactgagggaggcaaagggctggtcaatagattcatttcactgggagaggcaaagggctgggggccagagaggagaagtaaaaagccacacatgaagcagcaatgcaggcatgcttctggctcatctgtgatcaccaggaaactcccagatctgacactgtagtgcatttcactgctgacaagaaggctgctgccaccagcctgtgaagcaaggttaaggtgagaaggctggaggtgagattctgggcaggtaggtactggaagccgggacaaggtgcagaaaggcagaaagtgtttctgaaagagggattagcccgttgtcttacatagtctgactttgcacctgctctgtgattatgactatcccacagtctcctggttgtctacccatggacctagaggtactttgaaagttttggatatctgggctctgactgtgcaataatgggcaaccccaaagtcaaggcacatggcaagaaggtgctgatctccttcggaaaagctgttatgctcacggatgacctcaaaggcacctttgctacactgagtgacctgcactgtaacaagctgcacgtggaccctgagaacttcctggtgagtagtaagtacactcacgctttcttctttacccttagatatttgcactatgggtacttttgaaagcagaggtggctttctcttgtgttatgagtcagctatgggatatgatatttcagcagtgggattttgagagttatgttgctgtaaataacataactaaaatttggtagagcaaggactatgaataatggaaggccacttaccatttgatagctctgaaaaacacatcttataaaaaattctggccaaaatcaaactgagtgtttttggatgagggaacagaagttgagatagagaaaataacatctttcctttggtcagcgaaattttctataaaaattaatagtcacttttctgcatagtcctggaggttagaaaaagatcaactgaacaaagtagtgggaagctgttaaaaagaggattgtttccctccgaatgatgatggtatacttttgtacgcatggtacaggattctttgttatgagtgtttgggaaaattgtatgtatgtatgtatgtatgtatgtgatgactggggacttatcctatccattactgttccttgaagtactattatcctactttttaaaaggacgaagtctctaaaaaaaaaatgaaacaatcacaatatgttggggtagtgagttggcatagcaagtaagagaaggataggacacaatgggaggtgcagggctgccagtcatattgaagctgatatctagcccataatggtgagagttgctcaaactctggtgaaaaaggatgtaagtgttatatctatttactgcaagtccagcttgaggccttctattcactatgtaccattttcttttttatcttcactccctccccagctcttaggcaacgtgatattgattgttttggcaacccacttcagcgaggattttaccctacagatacaggcttcttggcagtaactaacaaatgctgtggttaatgctgtagcccacaagaccactgagttccctgtccactatgtttgtacctatggtccactatgtttgtacctatgtcccaaaatctcatctcctttagatgggggaggttggggagaagagcagtatcctgcctgctgattcagttcctgcatgataaaaatagaataaagaaatatgctctctaagaaatatcattgtactctttttctgtctttatattttaccctgattcagccaaaaggacgcactatttctgatggaaatgagaatgttggagaatgggagtttaaggacagagaagatactttcttgcaatcctgcaagaaaagagagaactcgtgggtggatttagtggggtagttactcctaggaaggggaaatcgtctctagaataagacaatgtttttacagaaagggaggtcaatggaggtactctttggaggtgtaagaggattgttggtagtgtgtagaggtatgttaggactcaaattagaagttctgtataggctattatttgtatgaaactcaggatatagctcatttggtgactgcagttcacttctacttattttaaacaacatattttttattatttataatgaagtggggatggggcttcctagagaccaatcaagggccaaaccttgaactttctcttaacgtcttcaatggtattaatagagaattatctctaaggcatgtgaactggctgtcttggttttcatctgtacttcatctgctacctctgtgacctgaaacatatttataattccattaagctgtgcatatgatagatttatcatatgtattttccttaaaggatttttgtaagaactaattgaattgatacctgtaaagtctttatcacactacccaataaataataaatctctttgttcagctctctgtttctataaatatgtacaagttttattgtttttagtggtagtga

SEQ ID NO: 10 - DNA, 25591 bp, Homo sapiens
tcactaccactaaaaacaataaaacttgtacatatttatagaaacagagagctgaacaaagagatttattatttattgggtagtgtgataaagactttacaggtatcaattcaattagttcttacaaaaatcctttaaggaaaatacatatgataaatctatcatatgcacagcttaatggaattataaatatgtttcaggtcacagaggtagcagatgaagtacagatgaaaaccaagacagccagttcacatgccttagagataattctctattaataccattgaagacgttaagagaaagttcaaggtttggcccttgattggtctctaggaagccccatccccacttcattataaataataaaaaatatgttgtttaaaataagtagaagtgaactgcagtcaccaaatgagctatatcctgagtttcatacaaataatagcctatacagaacttctaatttgagtcctaacatacctctacacactaccaacaatcctcttacacctccaaagagtacctccattgacctccctttctgtaaaaacattgtcttattctagagacgatttccccttcctaggagtaactaccccactaaatccacccacgagttctctcttttcttgcaggattgcaagaaagtatcttctctgtccttaaactcccattctccaacattctcatttccatcagaaatagtgcgtccttttggctgaatcagggtaaaatataaagacagaaaaagagtacaatgatatttcttagagagcatatttctttattctatttttatcatgcaggaactgaatcagcaggcaggatactgctcttctccccaacctcccccatctaaaggagatgagattttgggacataggtacaaacatagtggaccataggtacaaacatagtggacagggaactcagtggtcttgtgggctacagcattaaccacagcatttgttagttactgccaagaagcctgtatctgtagggtaaaatcctcgctgaagtgggttgccaaaacaatcaatatcacgttgcctaagagctggggagggagtgaagataaaaaagaaaatggtacatagtgaatagaaggcctcaagctggacttgcagtaaatagatataacacttacatcctttttcaccagagtttgagcaactctcaccattatgggctagatatcagcttcaatatgactggcagccctgcacctcccattgtgtcctatccttctcttacttgctatgccaactcactaccccaacatattgtgattgtttcattttttttttagagacttcgtccttttaaaaagtaggataatagtacttcaaggaacagtaatggataggataagtccccagtcatcacatacatacatacatacatacatacaattttcccaaacactcataacaaagaatcctgtaccatgcgtacaaaagtataccatcatcattcggagggaaacaatcctctttttaacagcttcccactactttgttcagttgatctttttctaacctccaggactatgcagaaaagtgactattaatttttatagaaaatttcgctgaccaaaggaaagatgttattttctctatctcaacttctgttccctcatccaaaaacactcagtttgattttggccagaattttttataagatgtgtttttcagagctatcaaatggtaagtggccttccattattcatagtccttgctctaccaaattttagttatgttatttacagcaacataactctcaaaatcccactgctgaaatatcatatcccatagctgactcataacacaagagaaagccacctctgctttcaaaagtacccatagtgcaaatatctaagggtaaagaagaaagcgtgagtgtacttactactcaccaggaagttctcagggtccacgtgcagcttgttacagtgcaggtcactcagtgtagcaaaggtgcctttgaggtcatccgtgagcataacagcttttccgaaggagatcagcaccttcttgccatgtgccttgactttggggttgcccattattgcacagtcagagcccagatatccaaaactttcaaagtacctctaggtccatgggtagacaaccaggagactgtgggatagtcataatcacagagcaggtgcaaagtcagactatgtaagacaacgggctaatccctctttcagaaacactttctgcctttctgcaccttgtcccggcttccagtacctacctgcccagaatctcacctccagccttctcaccttaaccttgcttcacaggctggtggcagcagccttcttgtcagcagtgaaatgcactacagtgtcagatctgggagtttcctggtgatcacagatgagccagaagcatgcctgcattgctgcttcatgtgtggctttttacttctcctctctggcccccagccctttgcctctcccagtgaaatgaatctattgaccagccctttgcctccctcagtaaaatgaatctattggtcaagggtgggttgtgactccaggggtggggtttgggcaaggaagttttgcaagatggacattcgagtttctgatagaatccaggtggccttctcaggggaactttgctgttcaggcttaatttgaaactttacttccttcccctccattttcctacactacccccaccatccagtgtgcagtttatttctcaaggacttcgccagcagccgctaataacctgaatgctgacaaataggaataagttacaactgaaaaggataagaattacgaatatcttagccatcaattcctggatcaggagttgtgacaatgtaacaacgtgttatcctgttattcatccaggctttatgtggaagaagccacagcctttcttggttttcaattctcttgagactacattgaatacacaatttcatcagtttttttttctttctttctttctttttcttttttttttttttttttttgagatggagtctcgctttgtcacccaggctggagtgtgcagtggcgcgatctctgctcaccgcaagctctgcctcccaggttcacgccattctcctgcctcagcctcccgagtagctgggactacaggcacccgccactgtctctggctaattttttgtatttttagtagagatggggtttcaccatgttagccaggatggtcttgatctcctgacctcgtgatccgcccacctcagcctcccaaagtgctgggattacaggtgtgagccaccgcgcccggccaatttcatcactttttagaatagaaataaacacctctatccagcatcaacttggaagaaagcagaataagaaacaaactagggaagtaaggggaaaactgggttttattactgtgttttttaatccatttagtagtcagtgtacttatctgaacaaaggagatttcctctgaatcattgaacaatagtccatgtcaaatcctacatatctacaaaattatgccagaacatctaatagtgttgggggagaagtgtgctgctctgttcaagcaagaggataggagattccgtggcccgtgctgggcattaggtcatttgtgtctggcacaggcttgatctatagtctaatgctgtgtttaacttgtctttatatctaatcaggcaaagacattcttcactgacaatattccacaggctgctgcacgtgtctcatgtgctgcacgtctcatgcgtctcaaacaagcaatttcaggaatagacagggcacacttccaccggcagagagaagaacagtttattttatattcttaaggcttactgtcctcatacttagaggttcaggatgctggtttgtgtgttacccctgagataaatccttacaagaaataaagtttaggaaatcacccccatgtgtatttcaaggagactctaaatttcaaagagttaaacccaatatattaaagctgaatttctgatattagagacacaatattttagtctacttgatatagttgagaggcagttacctgttttacttaggaacatggggaaagtttgtagtgacaaacagtttgaggcaaaaccaagattatctttaagagcagagatcgatgatatgaagaaaaagaagtggcaactttgactatatgcaggaaacacatttatattgagttgtggggactggcctcagaggaaacttcaggtcatgtcctttaatggccctaaaactcattcccaaaagaatttctgttcattgccatacctcatatccttaggtacatacatctaaaaccctgcgtaccagtgaacagctgccccatctttccatcagccaaccaggaattcagcagttactgctaacttccacttttctctcacccgctccaggaaaagtgacctgcagtcactttcctggaagtattgattctttcttgtttgtggctgttccccatttccaattgttttccatgattattgcttctactgtgatctatagactcttatatcatcaataccaggttatcattgcagttgtcaacttctctctgttgcatcttatgcattaattcaacaaatacatattagattccatatgtcatccatgaagtttcattcatatgccatccatttttcttaattctgagaatcttacatgaactagacagacagattctctggctaatggtgccctcactatagtgagcagaggagaccagcatacatactaaaagaaatgaattaataagagatttcagatggtattatatgacttgaagaaactgcatattgtacctacaaccatctggtcttttagaaacctgacaaaagcaagcaatggggaaaggattttcaatttaataaatgatgggggagaactggctagccatatgctgaaaaatgaaactggactccttccttataccttatccaaaattaactccagatggattagagacttaaatgaaaaaccccaaactataaaaagcctagaaaaaaatcaaggcaatactattcatgatataaacacgggcacagatttcatgatgaaagcgtgaaaagcaattgcagcaaaagcaaaaattgaccaatggaatctaattaaactaaagagctcctgctcagcaaaagaaactaccatcagagcgaaagacaatctacagaatgggaaaaagattttccaatctattcttctgacaaaggcctaatatccagagtaaacaagaaacttaaacaactttacaagaaaaaaaaaacccattaaaaccatggcacacttttacctataaaacaaacctgcatatcctgtacgtgtacccctgaatttaaggtaacagtaaattaaattaaaagaaaaatgccatggcaatgtcagaaagttaccctatatggcctaaaaagagaaggcataaataatccaaaacttgtttaacatatcatcaagaaataaccataaaaggaacaaccagcggccctcggggctgctctgcctatgcagtagtcattcgtttatttctttactctctcaagaaatttgctttgacttaaaaaaaacaaaaaacaaaaaagaaagaaagtgcatattctgaaacggtagtgactgcatttgaagtgggacctttatgatatgatggagccaggcagagatgttggagaagttcctgaaagaaggaagggcatgtgccaaattctgaggctgaggagaaaaaagaaagaaagaaaaaaagaataaagaactttacatttcactgtatgtaaagacattacaaggctagagtaaagcatgttgaagtaaaaataggagaaatcaaagttagagagaagggcgcaggcttattatttgggtcttatagatgagagtagtagagtaggtattttatactgaaacataggggacgaggggagctttgcaaacctgagataaacatggtctgtagtccactcaaaacccaagcttatttttttctccttcttcatctgccttactcagtgcaaggtgctataacaaaatacaaaagactgggtggcttcaacaacagagttttttctcacatttctgaaggctgactcgtggtcagggttctcttcctggattgcagatggcggacttctcactgtgtcctcaccgggaggaaagagaaatggcttgtctctctgcttctgataaggaaaataattttatgatggggatctgctcttatgagctcatctaaacctaattacttttcaaaagcctcccccacagataaggtcagttgggagttggggattcagcatgtgaattttgaggagacacaaacattaggtccgtaacaccatcatattaaactcttacttatagagatgcactaacatccaactatacaaaaattccattaagtaagccttccaattaatgttgtacaaattcttcccactacattttgatctcacagtgctggtctgtttctcagacataacatgctcatgctgacttgtgagcctctgctgattcatttcttacacctaagtccccacctcccccagagtcttacaatgaggtctctcccttgaaatgctgtgaccaatctgcacacttgagggcatgggattaatttcactttcttaggcatccacaagggctgtgaaaagctaagtgccattagaaatagtattcctcctaataaaatagaattgctacacctgactaaaccttgaattcctaaagcttggaacactttcccttccttaagaaccatccttgctactcagctgcaatcaatccagcccccaggtcttcactgaaccttttcccatctcttccaaaacatctgtttctgagaagtcctgtcctatagaggtctttcttcccaccggatttctcctacaccatttactcccacttgcagaactcccgtgtacaagtgtctttactgcttttatttgctcatcaaaatgcacatctcatataaaaataaatgaggagcatgcacacaccacaaacacaaacaggcatgcagaaatacacatacacacttccctcaatataaaccctttgtggctcatatatttaaaaagatgtaaaaaaaagagctgaagaaaatcatgtgtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggcctgtagtttaaagctaaagcatgtaccaatttttgaaaagttcagggattgtgaaatgtgttttaggcataggtccaggatttttgacgggacaaatcttagtctctttcagttagcagtggtttctaaggaaaaagtgctatacttctttttgaatatactctttgtgacttttgccattatctcttaatttctcaatagtgcagtgaaaacaatttctataaagccacagtttcagcgcagtaatagattagtgttacataatataagacctaatgcttacctcaatatctacttatccgtacctatttgaaataaatcatgactgtttcatcttagaaaaatatttgattccatattcaggtatgtatgtatacaccagatgatgtgtatttaccactggataagtgtgtgtgctggctgatgacccagggttttggcgtagctcttctatgctcagtaaagatgatggtagaatgttctttggcaggtactgtggattagaattaattatcttgtataaatgctaggttcacttctcagggaatcttactctaagacataagatgtgcgtgtacatggaaaacaactctaaagaggcaagggttgtttttattgactaatagtccacacactattataactcgaatattagtgtactttagacagctttatttctaacacagtgctgtttctgacatattggaccattaacagggtaggaagtatttatggtggttttttggttctgttttgcttttggttagtttgtttttgtttttctctgaaagtgatccatgatctctaaccttgctagattataatgccagaagctctggaattctggcttatcggaggcaagctgtatcttcaaattagtttatcccctaagctatcaggttgattgaaattattataatattggtgaaattctttcatccttcatgatcctgtgtaaagcttatatctgctcattgatacagatggctaaaaggccagaaagacacacatttacccatgtaacaagcctgcacatcctgcacatgtaccttcgaaattaaaatgaaatgaaataaaattaaaaggaaaaaaatgccatggcaacatcaggaagttatcttttatggtctaaaaatgggcagcataaataatctaccccttgtttagcatactattgaaaaataacaataaaaatcggcaaccagtagcccttgcgtctactctgcctatgaagtagccattcatttattccttcaattttttataaacttgttttactaaaaaaaaaaaggacaaagaaagaaagtgcgaattgtgaaatggtagtgagtgatggcatttgaagtgggtcctttatgatttgatggagccaggcagaagacgtttggagaaagaagttcctgaaagtaggaagggcatgtggaaaactctgaggctgaggaaaaaaaagaaagaaagaaatataaagaaagaacttgacatttcactgtatataaacacattacaagcctaaagtacgttgaagaaaaaatagaattcaaagttagacagaagggctcaggcttactatttgcatcttacagatgagagtagtagagttggtattttattctgaaacacagaggacaagtggagatttgtaaacctgagataaacatggtttctaatccactgaacaccgaagcttatttttttctctttcttcatctgccttacttagtgcaaggtgctataacaaaatagcatagactgggtgacttcaacaacaggattttttctcacttttctgctggttcctggtcagggctctcttcctgggttgcaggtggctgacttcccactgtgtcctcaccagaaggaagagaaatggctaatctctctgcttctgatgaggaaaataattctatgatggggatctgctctcatgagctcctctaaacctgattacttttccaaagcctcccccacaaatggagccaattgggagttggggattcagcatgtgaattttctggagacacaagcgttaagttcataacaccatcacattaaactaaactcttgcttattaacgtgcattaactttcaattatataagaactccagtgaatctgccttctcaattaatgttatacaaattcttcacactatattttcatctgaccgtgctgttctgctgctgagacatgacacgctgatgctgacttgtgagcttctgctggctcatttccttcacctaagtccccacctccctagaagcttacaatgaggtctcctccttgaaatgctgtgaccagtctgtagacttaagggtatgggattaatttcacctctttaggcatgcgtcaacacttaaaatgaaaagttccttagtaaagtaaggatcacttcattgtagttaccgtggaaagaaaaacctgtttcctgctctgatctctaacacctcaacctccctgtagagcctcacaagggctgagaaaagccagatgccgttggaaatagtattgcccctaataaaatagaatggctatccctgcctaaaccttgacttcctaaagcttggaacactttttcttcgttgagccccttcctcgctgctgtgctgcaatccagggaagggggttcagcccccttcactgaacctttccccatctcttccaaaacatctgtttctgaggagtcctgtcctatagaggtctttcttccaaccagatttctcctgcaccttttactcccacttgcagaactcccatgtacaagtttctttattgcctagttcttttatttgctcatcaaaacccacatctaacgtaaacaaaaaagtgtggagtgtgcacatgacacaaacacacatagccatgtataaatacacataaacacatccctcaacataaaaccctttgtggctcatatatttaaaaagacataaaaaaagaactgaagacaaccatgtgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgctttcccattaaatgcaggtagttgttcttcttgcagcactagtcactggccataatttaaatcttgttatcttcttgccaccatgaaccctgtatgctgtaggctgaaaacgttaaaagaaacacacgctctcacacacacacaaacacacgcgcgcacacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaatgaccatacttgtcctgcctccagatagatgttttaaaacgaataacaaaaataggggaaaggtgaaagttctttctaccgaaatctaataaagaaaagtcattttcctcatttccacctctcttttctcaaagtcaaagttgtccatctagattttcagaggcactccttaggccctaaaacattgccactgggtctcagcccagttagtcctctgcagtttcttcactcccaaccccagtatcttcaaacagctcacaccctgctgtgctcagatcaatactcagttgtctaagttgcctcgagactaaaggcaacagtgctgaaacatctcctggactcaccttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctgcttaattttttttatagcctttgccttgttccgattcagtcattccaatttttctctaatttattcttccctttagctagttttcttctcccaccatagaagataccaggacttcttttgtcagccgtttttcaccttcttgtctgtagctccagtgaggcctgtagtttaaagttaaagcatgtaccaatttttgaaaagttcagggattgtgaaatgtgttttaggcataggtccaggatttttgatgggacacgtcttagtctcatttagtaagcattggtttccaaataagaagtgctatacttatctttgaatatactctctgtggttttaggccattatctcttaagttctcattagtgtagtgaaaaatcctataaagcaacagtttcagtgcaggaatagattaatgttatgtaatataatataagactgaatccttacttcaatatctacttatccgtacctatttgaaataaatcacgcctgtttcatctcagcaaaagtattttttttatattcaggtatgtatgtaggcacccgatgatgtgtatttatcactggataagtgtatgtgctggctgatgacccagggttttggtgtagctcttctatgctcggtaaagatgatggtagaatgctctttaccagatactatggattagaattaattatcttgtataaatgctaggttcacttcttagggaatcttattctaagacataagacatgtatttgcatggaaaacaactcttaagaggcagggactgttttattgactaatagtccacacactgtgacagctgggatgtcactgtagtttagacatctttatctgtaactcagtgctgtttctgacatattggccacttaacatggcaggaagtattcatgctgtttttttctttattttttctttgggatttttattttttggtaggtttggttttgcttttgttttttctctgaactcgatccatgaccttggtagattatgacgtcagaaactctggaaatctggcttattggaggagagctctaccttcccctaacctatcaggttgataggaattataataatattggtggaatcctttcagacttcataatcctgtgtaaggcttatatctgctcaaagtgttaggcggctaaaagaccagaaagatacatgttgacctgcgcaacaaagctgcacatattgcacttgttctttggaagttaaaataaaagttgaataagaaaggaaagaaaaagatttgtcaacttatcagtatcttccagttactcacataataataagtgacttctctcaatctaaggatgggtgagaaagatttttattggtatgctggtacagattatagagactgaggtgaacccaaattagggtctctttaagataggggatctgtgagatgggtgtgtatagatctttggccatatctgagagtctggttgggttccatttgtagagcctgacctttaagaatgtgtcagagactggtgtctaagcccgctaaggcctaaacaagtgaatcttttgaatctctcttttttttttttgagacagagtcttgttctgtcacccaggctggagtgcagtggtatgatctcggctcactgcaactcctgccttccaggttcaagcaattctccttcctcagcctcccaagtagctgggattacaggcacttgccatcatgcctgtctaatttttgtatttttgtagagatgggatttcaccatgttggccaggttggtcttgaactcttgacctcaggtgatctgcctgccttggcctcccaaaattctgggattacaggcgtgagccaccactcccagcctctaaacaagtgaatcttaattgctcctcctcagactaaggaatatctaggatccctcctgttttcaaacaacttccccatttatccaaaaaccaaggcagtgttctaaaagtcatgtataaacccttatttcctcttatgcttttgaggcaatatcttttaagagtttgttgatttctccttatccataactgtcttattcctcgatttttcctatatcattgcttctgacattgattaaatcctaactgataaaactgtttctttacacaagcaatttcaagtgttttcaagcattctttcccatgtattttcaaacatttgttcagcaaatatctgttaaataaatgtcataatttttaaagtagtgggcatttaagttaaataagtcagagaataaaactttcctctgaagattataatctaggtagaacatacataaaattaataattaagttaaacaacaaaataatttcagatattattaactaagaatgaaattaaggagaaagtattcgaacagaggcaaaatgacagaaggaatctgccatgggaaggcattgccaaataaagtttagaagctgaaatagtaaattcaaagctctgaagcagaagaaaacaaactcctgctgtgccagagagttagataaagaaccagtgccgttgatatgtaaagtggagaatagcaggtggtattgtttcagggaagcataaacctaaggacataaacttgtcctcagtggtagggagtgagaagccattatagaattttaactctggtaatgacataatctctaagcaacctgtactattggctggattactattctaagaatgacctgtttatcacaactgttttgcttaaaaagcccttattgcctgtggacaattattagttattctttcaactattaaaaatcttgtcatgcagatgtgtgtgtgtgtgtgtgtattcattatgaatttgctttcaattaagttatcttgaattggcaatatctaaatctagatatagctccctaaggggtaaagagtgtatccactgcccacccctcaacatcacgtccttgattccttgatatcaaagggcagtatagttttgggggagaagaaaaagagagagagagaaaaaaagattgattaaaaatgcatattaccgacaaattagagggtgatggcagatgggaggcagcagaagtacattgcagctcccactcggatgcacagagcagcatgtgaagtctcccatcaggaattttttttgcagaaccacctgcagaaataaatcaagaaagctgagagaacgcacacaccctctgaaagaagcagattgctcctgcaggacccgggaaacaccccaaatattgtgagtgcccaaactgtggaagtggaaaagggggaccgtctacccccaaacacacatcctcactggggaacctgaagatctagaccacaggagaagattctgaccttacctggagctgagtcaatttagagggccaagcaaaatacaggggtagaggaagcagcgggaaaagccctgtgggctctctgggtcccctaggaagccatttctgccttgcctcacaggggtcatttgggagggctgccagaggaactgggaaaagatgacaggaaaaagaaaatctccacctggccagatctaggggctgggcagtgggggggttggtggggggacatgaatttggtgtgcagactccactggcagggaagtaggacagccctacttggtttcgcagctggtagcctggggcaagttctcagccttgctcactgactgcatggaaacagattcggtgctgttgcgggggagggtgcacgctggaagtgagaccaaccttttgagttgcatgggagctgggcaagtcacgtgactgcttgctttcccccactttcctgatgacctgcatgacacagcagaggcagccataattgtcctaggaacataaatccattgacctggaaactacacccccatcctcccacagtagccacagaaagacctgcccaaggagactctgagctcagacacgactagtcctgcccccacctgatggtccttccttactcaccctggtagctgaagacaaagggcatatattcttgggagttctagggtgccccagcccccccagccaccaccacctgactgcctctgctgatgctttctagaaagtgccacctcctggcaggaggccaaccagcacaaaaatagtgcattgaacaaccaaaagtaaggaccctcacagagtccatttcatcctctgccacctccattggagcaggtggttgtatctatggctgagagacccacagatggttcacgtcacaagactctgtgcagacaaaccccagtaccagcctggagtctggtagacctgatgggtggctagatccagaagagagataacaatcactacagttcggctctcaggaagccccacgcctaggaaaagggggactgtgctacatcaagggaacacctcatgggacaaaagtctcagccttgaggcctagactttccctctgacagagcctacccaagtgagaaggaaccagaaaactaactctggtaatatgaaaaacaaggttctttaacaccccccaaaaaatcatactagctcaccagcaatgcatccaaaccaagaagaaatccctgatttacctgaaaaataattcagaaggtcagttattaagctaatcaaggaggcatccgaggaaggtgaagtccaattttaaaaaaaccaaaaatatgatacaagaaatgaggggagaaatcttcagttaaagagatagcataaataaaaaacattcaaaacttcaggaaacaatggatgaatggatgcacttatagaaatgcaaaatgctctagaaagtctcagcaatagaatccaagcagaagaaattcagagcttgaagacaaagtttttgaattaacccaatccaacaaagacaaagaaaaaagaataagaaaatatgaacaaagcctccaagaaatctgggattatgttaaacaatcaaacctaagaataatcagcattcctgagaaagaagagaaatctaaaagtttggaaaacttatccagggaaataatcaaggaaaacttcccccaccttgctagagacctagatatccaaatacaagaagctcaataaacacctgggaaattcattgcaaaaatatcattgcctaggtacattgtcatcagagtatccaaagttatctaaagacaaagagaatcttaagagctgtgaggtgaaactaccaggtaacctatgaaagaaaacctatcagattaacagcagatttctcagcagaaaccgtaaaagctagaagtgaatatggccctatcttcagccttcttaaacaaaacaattatcagccaagaattttatatccagtgaaactaagcttcacaaatgaagaaaatacacagtgtttttcagaaaaacaaatgctgagagaattcggcactaccaagccaacactacaagaactgataaaaggagctctaaatcttgaaataaaccctggaagcacatcaaaacagaacctctttaaagcataaatcccataggacatatacaacaaaaatacagataaaaagatacacaggcaacaaataccacgaagaatggaatagtacctcacacctcaatactgatgttgaatgtaaatggactaaatgctccacttaaaagatacagaattgcagaatgaataagaattcaccaaccagttatctgccgccttcaggagactcacctaacacataaggactcacataaacttaaggtaaaggggtggaaaatgacattccacacaaatggacaccaaaagcgagccaaagcagctattcttatgtcagacaaaacaaactttaaagaaacagcagttaaaaaagacaaagagggacatcatataatgataaaagcccttgtccaatgggagaatattacaattcttaatatatatgcatctaatactggagatcccaaatttataaaacaattactactagactagacagcaacataataatagtgggggacttcaatactccactgactgcactaggcaggtcatcaagacagtctacaaagaaacaatggatttaaagaacaaatggacttaacagatatttacaggacattctacccaacaactgcagaatacacattctattcatcagcacatggaactttctccaagataggccatatgatatgccacaaaacaagcctcaataaatttttaaaaattgaaattatatcaagcactctctcagaccacagtagaataaaattggaaatcaactacaaaaggaaccttcaaaaccatgcaaatacagggaaattaaataacctgctcctgaatgatcattgggtcaacaatgaaatcaagatggaaatttaaaaatcatttgctttgaaaaccggcacaagacaaggatgccctctcgccactcttactcaacatagtattggaagttctcgccaggacaatcaggcaagagaaagaaataaagcatattcaaataggaagagaggaagtcaaattgtctctgtttgcagatgacatgattgtatatttagaagaccctgtcatctcagcccaaaatcttaagctgataaacagcttcagcaaagtctcaagatacaaaatcagtgtgcagaaatcacaagcgttcctatacaccaataatagacaagcagagagccaaatcatgggtgaactcccattcacaattgctgcaaagagaataaaataaaatacctagaaatacaacttctaagggatgtgaagaacctcttcaaggagagctacaaaccactcactgctcaaggaaataagagaggacacaaacaaatggaaaaacattccatgctcatagatagaaagaatcaatatctttaaaatggccatactgcccaaagtaatttatagattcaatgctatccccatcaagctaccactgacttttttcaaagaattagaaaaaactactttaaatgtcatatggaatcaaaaaagagcccatatagccaagacaatcctaaacaaaaagaacaaagctggaggcatgatgctacctgacttcaaactatactacaaggctacagtaacaaaaacagcatggtactggtaccaaaacagatatatagaccagtggaacagaacagaagcctcagaaataatgccacacatctacgaccatctgatctttgacaaacatcacaaaagcaatggagaaagaattccctatttaataaatggtgctggaaaaactggctagcaatatgcataaaactgaaactgtaccccttccttacaccttatacaaaaattaactcaaggtggattaaagacttaaatgtgcaacctaaaaccataaaaatcctagaagataacctaggcaataccattcaggacataggcatgggcaaaaattcacgactaaaacatcaaaagcaatgacaacaaaggccaaaattgacatatgggatctaattaaactaaagagcttctgcacagcaaaagactatcatcagagtgaacaggcaacctacagaatgggagaaaatttttgcaatctatccatctgacaaagggctaacatccaaaatctacaaagaacttcaacaaatttacaagaaaaaacctaacgaccccatcaaaaagtggacaaaggatatgaacagatgcttctctaaagaagtcatttatgtggccaagaaacacatgaaaagaagctcatcatcactggtcattagagaaatgcaaatcaaaaccacaatgagataccatctcatgccagttagaatggcaattattaaaaagtcaggaaacaaaaggtgctggagaggatgtggaagaataggaaaaattttacactgttgatgggtgtgtaaattagttcaaccattgtggaagacagtgtggcgattcctcaaggatctagaaccagaaatactgtttgacccagcaatcccattactgggtatatacccaaagaattagaaatcattctactataaagacacgtgcacacgtatgtttattgtggcactattcacaatagcaaagacttggaaccaacccaaatggccatcagcgatataatggataaagaaaatgtggcacatatacaccatggaatactatgcagccataaaaatgatgagttcatgtctttgcagggacatggatgaaggtggaaaccatcattctgagcaaactaacacaggaacagagaaaccaaacaccacacgttctcactcataagtgggagttgaacaatgagaacacatggacacagggaggggaacatcacacaccagggcctgtcggggggtgagggggttaggagagggataacattaaaagaaatacctaatgtagatgacaggttgatgggtgcagcaaaccaccatggcacatctatacctatgtaacaaacctgcacattctgcacatgtatcccagaacttaaagtataataagaacaacaaaattacttgaactgaccgacaatagtgacacaacctatcaaaacctctaggatacagcaaagatggtgctaaaaggaaagttcacagccctaaatgtcgatgtcaaagagtctgaaagaggacagacagacaatataaggtcacaccacaagaaactagagaaacaaaaacaaacagaaccaaaacccagcaaaagaaagggaataactaagataagaggagaactaaatgaaattaaaacaactgcaaaaaaatacaaaagctaaatgaaataaaaagctggttctttgaaaagataaataaaactgatagaccattagcaagattaaccaagaaaagaggagagaagtgcaaataaactcaattagaaacaaaacaggagatactattactgataccacagaaatacaaaagattattcaaggctactatgaacacctttacatgcataaactagaaaacctaaaggagacgttcgaattcctggaaagatacagggctctagcttaagtcaggaagaattagataccctgaacagaccagtaataagcagcaagactgaaatgataataaaaatttaccaacaacaaaaaagtccaggaccagatagattcacagctgaattctaccagacattcaaagaagaattgataccaatcctattgacagtattctacaagatagagaaagagagaatcctccctaaatcattctatgaagccagtatcaccttaataccaaaactgggaaagaacataaccaaaaaaaaaaaacactacagatcaatatccctgatgaacatagatgccaacatccttgacaaaatactagctaatagcatccgacagcatatcaaaacccatgatcaagtgggtttcatgcgagggatgcacggatggtttaacatacgcaagtcaataagtgtgatacacaacataaagagaattggaaacaaaaatcatgtgattatctcaatagccacagaaactgcattcaacaaaattcaacatcactttatgactaaaactcagcaaaatcggtttacaaaggacatacctcaatgtaataaaagccagctatggtaaacacacagccaacattatattgaatgggaaaaagttaaaagcattctgtctgaaaactggaatgagacaaggatacccactctcaccacttctctttaacatattactggaagtcctagcaagagcaatcagacaagagaaacaagtaaagcacatccaaattgttaaagagaaagtcaaactgtcactgtttgctgatgatatgattgtgtatgtagaaaactctaaagactcctccaaaaccccctagaactgataaaataattcagcaaagtttctggatacaaaattaacgtacaccaatgagttgctttcttacataccagcaatgaccaagctgagaataaaatcaagaactcaaccccttttacaatagctgcaaaaaacaaaacaaaacaaaacaaaaacttaggaatatatacctaaccaaggaggtgaaagacatctacaaggaaaactacaaaacacggctgaaagtaatcatataagacacaaacaaatggaaacacatgccattctcatagatgggtagaatcaatattgtgaaaatggccataatgccagaagcaacctacaaattcattgcaattcccatcaaaataccaccattagtcttcacagaactagaaaaaacaatcctaaaattcttatggaaccaaaaaagagcccaataaacaagcaagtctaaaaaaaagaacaaatctgaaggcattacattacctcatttcaaactatacaataaggccatagtcaccaaaacagcatgatgctggtgtacaaataggcacatcgaccaatggaacagaatagagaacccagaaataaactcaaatacttacatccaactgatctttgacaaagcaaacaaaaacataaagtggggaaagggcaccctattcaacaaatggtgcggggatagctggcaagctacatgtaggagaatgaaactggatcttcatctctcaccttatacaaaaatcaactcaagatggatcaaggacttaaatctaagccctgaaactgtaacaattctagaaaataacatcggaaaaacccttctacacattggcttaggaaaggatttcatgaccaagaacacaaatgcaaatacataaaaacaaagaaaatatctgggactaaattaaactaaagagcttttgcatggcaaaaggaagagtctgcagaataaacagacaacccacagagtgggagaaaatcttcacaatctatacatctgacaaaagaataatatccaggctctaaaatgaacacaaatagattatcaagaaaataacaaacaatcccaataaaaagtaggctaaggacatgaacagacaattctcagaaaaagatatacaaatgaccaacaaacatatgaaaaaattctcaacatcactaatgatcagggaaatgcaaatcaaaactacaatgagatatctacttactctagttaaaacggctattaacaaaaaagacaaaaaataacagatccttgtgaggatatggagaaaagggaactctttcttacacactgttggtgggaatgtaaaatagtacaaccattatggaaaacagtatgaagatttctcagtaaactaaaaacagaactatcatacaatccagcaatctcactagtggttatttatccaaaagaaaggaaatcagtatatccaatggacacattacactcatgtttattgaagcactattcacaatagttaaggtttgggatcaacctaagtgtctatcaacagatgaacggattaaaaaattgtatttttgcacagtactattttgccatgaaaaagaatgaaatcttgtcatttgtagcaacatggatggaaccagaggtcattatgttaattgaaagccctgaagcagaacaaaaacaaactcttggtatgccaaagagatagataataaaataagccagatacagaaagtcaaatatcacatgtttttattcatctgtgggagctaaaaaagtgggtctcatggtggtagagagtagaatgatagttatcagaggctggaaaaagtgtgagtgtgtatgggaggggatttaagagatgttggttaataggtacaaacacagttggatagaaggattaagccataatgtttgatatttgagtagggtgactatagttaattactatttattatatatttcaaaatggctagaaatgaggatttgaaattttctcaatacatagaaatgataaatgctcaaagcaatggatatcctaaatatctagacttaatcatcacatgttctaggcatgtaagtatcacatgtaccccataaatat

SEQ ID NO: 11 - DNA, 25396 bp, Mus musculus
gtttttaaggctcattactggggtcttatgaaatttccataataccctgtaaatggaagcatttttttttcaataaatctatcttgaatatccagtgtgggttgggatctaatctctccttcatacagttggactgcttttatttatatggagttactagagttaacacaataggtaatatacccttgatttgtttttctttccataaccaccaggttatgcacaattccggaaataaaatgtgtgttccaagtgttctttacgctactctctggtacagttttagtgagattttgaaatgactacatataataagtggcctttaattacagaatggtttgtgtaggtacagaataaaatacaccaaatattatgagtttgagtcattgtcatgagtcataaaaatgcagctccaaacgaagtaaagagttagagtatggtgagaaattataaaccatcaagaacaaaatataggacccataaaggtagttgtgtggccaggtatttcgtgcatatttataatccttatttattattactaagaagccaagcagtatttataaaatatggtcctctctgaatgcaatatccaatggtctaaaacccatatcttagtgttctcagagcagtatcttttgtttgcaaatagaactgaattttttataactgtctcataatttatgtaagacttttgcctagccataaagataggatgagcaattctttttgcagtaggtagaacccttgcctgttttttcttgacttaatgaagatcagtaatagatcttggtttatagagagttagttggtagtagacatcatttcacagttgcattcctcgactgaatcctaattaaaatgtattagttttgttttctctgaggcagacagtgctggtggcttttcccatggtgcttccaggtactggtaccatagggtctagtcgaaagttgctctctggatctggaagaactgtcagaggcctggttgaatgttaccctctggatgaactgtagctggaggcatgtatgcaaagttcttccccactactttcctaagaaacaaatacactttgcatatgtgttttaaaagttatatgctaagtacacacccaatagttagctgtatctgtcagcagccagatcatgcaatgtgctgatgtgttgatacaaaaatattactgctgactgtctcatcgtgatagaaatatttgttgagttacttaactagagtaccaaaaatgaaaataaactagcattcaattatattcatctcaatactctattgataagtgtaccacatatcttgttaggtacacaaacaggaagggacttaacagtgtagtttagcttttttgtttacaagccctctcaatggacactgatcagagaatgaataatattaaatatcatggaaatggaaacaaatgcagaaagtttcatcagtccagacaaaataagggttaggacacaagaaagtgaaaaagagaggtatgtaaggtgacttgagaagaggaacatgcagttcaacatacacatacacatacacatacagttccacacagaggaaggggaagggagagagaaatgctgctaacccaggaaagtcaaagtaggggcttataatgggaaagattctaatgatttaaaaggagcatgactttattgttatccacttagcaagctaatctgttcatgcattattttgggcaaaagtctttaagccaacaatgagtttatcgtagtaacacagcacaaggtccataacattacttgttcttcttatcatcaggctgtttctactgttacctgtattcttcaaattctcctaatatttttaaaagaaagaaatatttagtaaagctctatgatcactaaattaatagacatccatgaatagctatccagaggggaagttttaaatgcccagacttggcaaattagatagaatctctttatggttttcctttgctgactcaataaggaaaaagataagggaacttgaattaagcatggatgaatgatatagtgttgctttggtctgaaatatgaggtataatttatcatttatatgaaaaggagtctcatgccaggcgttggtggcacactcctttaatcccagcactcgggaggcagaggcaggcagatttctgagtttgaggccagcctggtctacagagtgtgatccaggacagccagggctacacagagaaaccctgtctcaaacctcctgccccccccaagaaaaaaaaagaaagaaaaggagtctcatatcttgacagccatcaatcatcacagcgtatgcaatcgtcactttactcagcaatgtacacacaagggtatgggggacttttgggatagcattggaaatgtaattgaggaaaatatgtaataaaaaatattaaaaaaaaaaagaaatccacctccactaatccaggttaacatgccttttgataccattgttcatacagttatttttaaaatagcaattctatgaatgaagaataaaacatttcttcactgtcaaaaaaaaaaaaaaaaaaaaaaaaaaaaaaaaaaaaaaaccacagctttcagacagctttccttgactgttgaatctatggtgatatgtgataagaacctggaagtctatgtgattttctccttaggaacgatagtggcagtgttataagctagtttatagttctgtctaaaaccatattatacactttataagtttttatgtataatgtaaaaatatattttaatcaattataaactgataattacattttcaagatgaaagagttaattatttgatggaggtacatgtttaggctagttaacaattttgattgtcatttcacacagataaaaatattgaaaagaaatcatgatcagaactgagactttcaaaaacccaagaatcatctatctcatagtctcccttatatacaaggctaaattaggctgatatggccacttctttttataatcacagaagtacttaggtggtcttaaaacttttgtggctggagtttaatctgaggaataataccatcaaccatattgcagctctaacataaatactacagtagccagtgaagtagtacacaggaaaccatcacagaagccttcccagtaagcagaactgctcatttcgccaccattcttgtcatatatgaagttatgagggctttaagagattctaatttgtatagatttatttatatttatactgtgttcctattgtttttttatttacctggtaaacagaacataacaatgatctgtgccagtgtacattcatagtaactctgctgttatacactgacatgtataaataacaaactacactgaatatgttatgtttattttatagcttttgtttctttgtttttgagattataatttaattataatgtttcttcctcctctctatccccaaacaacctcaaataactctcacaactctccttcaaattctcttttcatcagtattattgcacacatatatggatgtgtatagatggtttgttgtgtcaggctgagtgcaaatgctctcttatatccatctattttttcctgtacatggagctgtgcataggtactgagacctcttcacttctggggaagtcccaatacatcacaggcttgtaggacagatacagaactactccagattcacttcaagaatcttaatcttacattcctgagcatactaaaatcttcataaaaatcaggcagcacaagtccctcccgcccctctcgagcaccgggatacctcgccagcggagtcgaccaacacccgcaagggcccacacaggattccccacgggatcctaagacctctggtgagtggaacacagcgtctgccacaatccaatcgagcggaacctgagactgcaggaaatagggaagcagactacccgggcctgacccgggccacaagtcccttccactccactcgagcactggagtgccttgccatcggaatcgcctgacacccgcaagagcccacacaggattcccaacgggatcctaagacctctagtgagtggaacacaatttctgccaggaggcaggttcgaacaacagatatctgggtaccttccctgcaagaagagagcttgcctgcagagaatactctgcccactgaaattaaggagagagctagcctcccaggtctgcttatagaggctaacagagtcacctgaagaacaagctcttaccagagacaactataacagctagcttcagagattaccagatggtgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttctcaaatcacttaaagaattacaggagagcactgctaaagagttacaggcccttaaagaaaagcaggaaaacacaaccaaacaggtagaagtccttaaagaaaaacaggaaaacacatccaaacagatgatggaaatgaacaaaaccatactagaactaaaaagggaagtagatacaataaagaaaacccaaagcaaggcaacgctgaagatagaaaccctaggaaagagatctggaaccatagatgcgagcatcagcaacagaatacaagaaatggaagagagaatctcaggtgcagaagattccatagagaacatcaacacaacagtcaaagaaaatacaaaatgcaaaaggatcctaactcaaaatatccaggaaatccaggacacaatgagaagaccaaacctacggataataagagttgatgagaatgaagattttcaacttaaagggccagctaatatcttcaacaaaataatagaagaaaacttcccaaacataaagaaagagatgcccatgatcatacaagaagcctacaaaactccaaataaactggaccagaaaagaaattcctcccaacacataataatcagaacaacaaatgcactaaataaagagagaatattaaaaggagtaagggagaaaggtcaaataacatataaaggaaggcctatcagaattacaccagacttttcacagagactatgaaagccagaagagcctggacagatgttatacagacactaagagaacacaaatgccagcccaggctactatacccggccaaattctcaattaccatagatggagaaaccaacgtattccacaacaaaaccaaattcacacattatctctccacgaatccagcccttcaaaggataataacagaaaagaagcaatacaaggacagaaatcacgccctagaacaagcaagaaagtaatccctcaacaaaccaaaaagaagacagccacaagaacagaatgccaactctaacaacaaaaataataggaagaaacaattacttttccttaatatctcttaatatcaatggactcaatttcccaataaaaagacatagactaacagactggctacacaaacaggacccaacattctgctgcttacaggaaacccatctcagggaaaaagacagacactacctcagagtgaaaggctggaaaacaattttccaagcaaatggtctgaagaaacaaggtggagtagccattctaatatcggataaaatcgacttccaacccaaagttatcaaaaaagacaaggagggacacttcatactcatcaaaggtaaaaacctccaagaggaactctcaattctgaatatctacgctccaaatgcaagggcagccacattcattaaagatactttagtaaagctcaaagcacacattgcacctcacacaatagtagtgggagacttcaacacaccactttcatcaatggacagatcgtggaaacagaaactaaacagggacacagtgaaactaacagaagttatgaaacaaatggacgtgacagatatctacagaacattttatcctaaaacaaaaggatataccttcttctgagcacctcacgggaccttctccaaaattgaccatataataggtctcaaaacaggcctcaacagatacaaaagtattgaaattgtcccatgcatcctatcagaccaccacagcctaagactgatcttcaacaataacataaataatggaaagtcaacattcacgtggaaactgaacaacactcttctcaatgataccttggtcaaggaaggaataaagaaagaaattaaagactttttagagtttaatgaaaatgaagctacaacgtaccaaaacctatgggacacaatgaaagcatttctaagagggaaactcatagctctgagtgcctccaagaagaaacgggagagagcacatactagcagcttgacaacacatctaaaagctctagaaaaaaaggaagcaaattcacgcaagaggagtagatggcaggaaataatcaaactcaggggtgaaatcaaccaagtggaaacaagaagaactattcaaagaattaaccaaatgaggagttggttctttgagaaaatcaacaagatagataaacccttagctagactcactagagggcacagcgacaaaatcctaattaacaaaatcagaaatgaaaagggagacataacaacagatcctgaagaaatccaaaacaccatcagatccttctacaaaaggttatactcaacaaaactggaaaacctggacgaaacggagaaatttctggacagataccaggtaccaaagttgaatcaggatcaatttgaccatctaaacagtcccatatcccctaaagaaatataagcagttattaatagtctcccagccaaaaaaagcccaggaccagatgggtttagtgcagagttctatcagaccttcaaagaagatctaattccagttctgcacaaactatttcacaaaatagaagtagaaggtactctacccaactcattttatgaagccacaattactctgatacctaaactacagaaagatccaacaaagatagagaacttcagaccaatttcccttataaatatcgatgcaaaaatcctcaataaaattctcgccaaccgaatccaagaacacattaaagcaatcatccatcctgaccaagtaggttttattccagggatgcagggatggtttaatatacaaaaatccatcaatgtaatccattatataagcaaactcaaagacaaaaaccacatgatcatctcattagatgcagaaaaagcatttgacaagatccaacacccattcatgataaaagtcttggaaagatcaggaattcaaggcccatgcctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaagggaatacaaattggaaaagaggaagtcaaaatatcactttttgcagatgatatgatagtatatatataagtgaccctaaaaattccaccagagagctcataaacctgataaacagcttcggtgaagtagctgaatataaaataaactaaaactagtcaatggcctttctctacacaaagaataaacaggctgagaaagaaattagggaaacaacacccttttcaatagtcacaaataatataaaatatctcagcatgactctaactaaggaagtgaaagatctgtatgataaaaacttcaagtctctgaagaaagaaattaaagaagatctcagaagatggaaagatctcccatgctcatggattggcaggatcaacattgtaaaaatggctatcttgcaaaaagcaatctacagattcaattcaatccctatcaaaattccaactcaattcttcaacgaattagaaggaacaatttgcaaattcatctggaataacaaaaaacctaggatagcaaaaactcttctcaaggataaaagaacctctggtggaatcaccatgcctgacctaaagctttactacagagcaattgtgataaaaactgcatggtactggtatagagacagacaagtagaccaatggaatagaattgaagacccagaagtgaacccacacatctatggtcacttgatctttgacaagggagctaaaaccatccagtggaagaaagacagcattttcaacaattggtgctggcacaactggttgttatcatgtagaaggatgcgaatcgatccatacttatctccttgtactaaagtcaaatctaaatggatcaaggaacttcacataaaaccagagacactgaaacttatagaggagaaagtggggaaaagccttgaagatatgggcacagggaaaaaatttctgaacagaacagcaatggcttgtgctgtaagattaagaattgacaaatgggacctaatgaaactccaaagtttctgcaaggcaaaagacaccgtcaataagacaaaaagaacaccaacagattgggaaaggatctttacctatcctaaatcagataggggactaatatccaacatatataaagaactcaagaaggtggacttcagaaaatcaaataaccccatttaaaaatggggctcagaactgaacaaagaattctcacctgagggatatcgaatggcagagaagcacctgaaaaaatgttcaacatccttaatcatcagggaaatgcaaatcaaaacaaccctgagattctacctcacaccaaccagactggctaagatcaaaaattcaggtgacagcagatgctgaagtggatgtggagaaagaggaacactcctccattgttggtgggattgcaagcttgtacaaccactctggaaatcagtctggcggttcctctgaaaattggacatagtactaccagaggatcccgcaatacctgtcctggccatatatccagaagatgccccaactggtaagaaggacacatgctccactatgttcatagcagccttatttataatagccagaagctggaaagaacccagatccccctcaacagaggaatggatacagaaaatgtggtacatctacacaatggagtactactcagctattaaaaagaatgaatttatgaaattcttagccaaatggatggacctggagggcatcatcctgagtgaggtaacacattcacaaaggaactcacacaatatgtactcactgataactggatattagtccaaaacctaggatacccaagatataagatacaatttcctaaacacatgaaactcaagaaaaatgaagactgaagtgtggacactatgcccctccttagaagtgagaacaaaacacccatggaaggagatacagagacaaagtctggagctgagacgaaaggatggaccatctagtgattgccatatccagggatccaccccataatcagcatccaaacgctgacaccattgcatacactagcaagattttatcgaaaggacccagatgtagctgtctcttgtgagattatgccggggcctagcaaaaacaggagtgaatgatcacagtcagcaggtggatggatcacagggctcccaatggaggagctagagaaagtacccaaggagctaaagggatctgcaaccccccaggtggaacaacattatgaactaaccagtaccctggagttcttgactctagctgcatatgtatcaaaagatggcctagtcggccatcactgtaaagagaggcccattggacacgcaaactttatatgccccagtacaggggaacgccagggccaaaaagggggagtgggtgggtaggggagtgggggtgggtcggtatgggggacttttggtatagcattggaaatgtaaatgagctaaatacctaataaaaaatgaaaaagaaaaattagtcaggatgtaagaaccagaggtattcagcctagagacccatgattgaacaagacaggcaaaaactttttttaaaaagtcaatgaaatgatgcctgatgatattctcatgtactcattgattgattggtgcccagttcagttatcgttggagatcatcatccagcaacggataggagcagacacagagacccacagccaaacactaggcagagcagctggatcccaaggaagaggacgaggaagaattgtaggagtcaggtattaaggactctgtgagaacagactgactaaacaagtaagcaggattcataggggctcacagagagggagagagggagggagggagggagggagggagggagggagggagggagggagtgagggaaggagggagaaagagaaagagaaagagagagggagatgagagagagaaaggagagtgagagaaaggagagagagaggagagagagagaaaggagagagagagagaaaggagagagagagagaaaggagagagagagaaaggagagagagagagagagagagagagagagagagagagagagcgagagagagagagagagagagagagagagagagagagagagagagagagagagagagagagcgagctgaggtaattcactactcagtagtgcatgttgcttcttcccttcacaggggaagttcccttcttattttcacatatctctttcatgccctgagtcattctcatccctaagtgcctccctcatcatctcacacagaagcttctcttcccaggtccttctcctcccacttttgtaccttctccttgtgtgaacctcagagcttatttaaggcttcccatggtttttaataccaagaaggaaaagcacaccagaagttcttagcatgaaaagtttaggacattttatgtgagagtttagaggacaaaacaagattgaaaaggaatgaagataaaattaaataatttaagagtaatgaaaaatatagagtacaaatgggaataggtggggactatgaagtaaaaaaatgattctaaaacatatgcagtatacacagtgcccaggaagcagcagaatgagcgactgaattagtgagagaaggagagagagagagagagagagagagagagagagagagagagagagagagagagagagagagagagagagagaggaagaaaactcttcaacacttaacacagggagaatatctttcaagatcccttcactgggtttacctgtcactaggaaaacctttctcacttctttccctccctctttctttatctctgaatattgccactaatcttagggttataagtagctttgtatttcttttttattttttccaaattgagagttctgtgtttccttctctggctcccaaaaactaaaagagagagcaatgtccaagacgtgatcaattcacttgtgtgctacttcccataaatcatgtgactaaattaacaaattaaagaatgaaggaaacaaaccaaacaagtatgaaagaaatgaatatatatttattttcctacctgaaggtttcttcaaaacatgaagaaaaatagttagaaaaacaatagaaaaatgattattttgtcttcttttcttatgttccataattggggtgatcctcttgtgcactcaaactaaaagaaaacgaaccaacatacccagatcaaaacaaaacagaacaggcaaattttcttatgtataatgtgttttaattttttatttgtgtagtaaacaatattgaagagataatattgaacagacaagctatgttattggtgcaagaattgaaaaatacagtatttaaagaagatgttatagaaacagaattagctgcaaggataagaacagacactactcagagtgagacccagaactcaaatgtcttaagcctgggccatagccaccctgtgtagatatggttgtcatctctgaagcctcaccctgcagggtaacaccctggcattggccaatctgctcagagaggacagagtgggcaggagccagcattgggtatataaagctgagcagggtcagttgcttcttacgtttgcttctgattctgttgtgttgacttgcaacctcagaaacagacatcatggtgcacctgactgatgctgagaaggctgctgtctctggcctgtggggaaaggtgaacgccgatgaagttggtggtgaggccctgggcaggttggtatccaggttacaaggcagctcacaagtagaagttgggtgcttggagacagaggtctgctttccagcaggcactaactttgagtgtcccctgtctatgtttccctttttaggctgctggttgtctacccttggacccagcggtactttgatagctttggagacctatcctctgcctctgctatcatgggtaatgccaaagtgaaggcccatggcaagaaagtgataactgcctttaacgatggcctgaatcacttggacagcctcaagggcacctttgccagcctcagtgagctccactgtgacaagctgcatgtggatcctgagaacttcagggtgagtctgatgggcacctcctgggtttccttcccctggctattctgctcaaccttcctatcagaaggaaaggggaagcgattctagggagcagtctccatgactgtgtgtggagtgttgacaagagtttggatattttattctctactcagaatcgctgctccccctcactctgttctgtgttgtcatttcctctttctttggtaagcttttaatttccagttgcattttactaaattaattaagctggttatttacttcccatcctgatatcagcttcccctcctcctttcctcccagtccttctctctctcctctctctttctctaatcctttcctttccctcagttcatttcttcttctttgatctacttttgtttgtctttttaaatattgccttgtaacttactcagaggacaaggaagatatgtccctgtttcttctcatagctctcaagaatagtagcataattggcttttatgccagggtgacaggggaagaatatattttacatataaattctgtttgacataggattcttataataatttgtcagcagtttaaggttgcaaacaaatgtctttataaataagcctgcagtatctggtatttttgctctacagttatgttgatggttcttccatcttcccacagctcctgggcaatatgatcgtgattgtgctgggccaccacctgggcaaggatttcacccccgctgcacaggctgccttccagaaggtggtggctggagtggctgctgccctggctcacaagtaccactaagccccttttctgctattgtctatgcacaaaggttatatgtcccctagagaaaaactgtcaattgtggggaaatgatgaagacctttgggcatctagcttttatctaataaatgatatttactgtcatctcaattctgtgttttgattacttttgtttcttgcaaggattaatgtgaaatatttattatataaagcagttggggcatgctggagggaaggaagtgagggtaaaagtcatgccattctatttcagttaaaaccattcaagaataaaataccaaagaggaagtgagagttcagaaacaaggtattcactttgacttcctggtaattgacttctgcagctttgtgataagtggtgagatagtaagtggctattccgtcagcaaccttccctgacatccatttctcagaaaaagaagttaaataggggtttaatttacagcatagacatatactatgttttatagttttttgtattgttctaatttttcctcacaaatgccccttgattttctgcttgttgtctagtatctcagagactttagtctaatttctcttgcctcaagtatccatcactcttttcttttatctatctatctatctatgtatctatctatgtatctatctatgtatctatctatctatctatctatctatctatctatctatctatctatctaaaatatatatcaaatatattttttcttttttattattttctttatttacatttcaaattttatcccctttcctagtttcccctccaaaaatcccctctcccctctcccctccccctgctccccaacccacccactcccattcctggtcctggcattcccctatattggggcgtagagccttcacaggaccaagggccttgattactattcaagggtgtcttccttgcttgcttttctatgaacattatccattttctcctgacctctgttatcttagaaaaccccactgtgttacagagatatgcttgaagaggaaacccaggagctcttgagccctggtacccagcctctcccattaacaatgataatgaaacttcacatactcacaacttgaactagagaacaggaggcaataataaggggtaaataaggactatggaaaatatgagcagaaatgttttgttctttgatagcctttgcagacataggaagttttcatgggctcatagcaaagagaagtccatttcccctagtgtgtctgtcttgaatatccactaaggacatggagattggactctctttggactggtctctgttgtttcccctcctggttttataattgtttgtattattcttggcaacacttcatgttcacagtttcccactctttaagcacttgtctcatgctaaattctggagacaaaatatgagtttcaagtgttccttatcctgaactacaaggtaatgttgttggagtaatacatatgatacatatgaatagttagagaccaattatgagattacaggataagccatcaaaatgaaatcaaattaaactgtcgcctttaactaaaaaacgaaccaaagccttaagatataaaagtgcaaaatatctagaatgaaaagaagagcaaaatttattaatattggctgtgaaccaggtttgtagtgcatgcctgtgttgccagcccttgagaacctgaggcacaaccataaagtctgcctaggatacacggtgaaaggtttgttttaatagacaacagccacattcaacattttaaaggaaaagctcagataagaaggacaaaaatggacaagtcaaatgtgactaataaagtttttgcatagcatggagaataatcaacaaaatgatagttaatttaaaatgggagaaagtatttgtgaactaatatccaacagtggatcactatgcaaagtgtgtaaggaacccatgcaacccactagaaagaacatggaacacaaaaaggaagaaaacagatatattttttttcaaaagaagtcacacaaatttctaacacatttatgaaaaagaactcaatattagggcaatgcaaatcaaaacatatcaagagatatcactgttttcttttggaacagttgtcatcaaggaggcaaaagacatgtgttagagcagatgtaactgtgtatatgaatgtttcgtatatagatagactagcagctagtagtgctaatgttgacatcctcccaaggtagttttgtagatgaggcattcttctgtcttttctcatagtgcatgcaataattatgcatgggtatggtgagacattttagggtgtgtgtgtgtgtgtgtgtgtgtgtgtgtgtgtgtgtgtgtgtgtgtgtgagagagagagagagagagagagagagagagagtgtgtttttactggaagtcacccacattcatacagtccatcacaatctattcaactgcaaaaaactgaaagtgacctggtaaagtattatgtctttatgtctttactaagtgcctttagtagaaagcccccagttaagaagtgactctaaatgcaaaccagcaatcaaactctgcaagctcttttacaaatggcagaacatcactctaatatcagttaaataaggacaggaaccagctgaacaccgggttaaaaaaatgcaatgacttgatctgccaggatggggggaatatcaagggtagctgccactctctcagaaaagaaggggagaggcaatgcagggaagggctgtgtgaggggaggactgggaagggggtataattgggatataaagtgaataaataaattaattaatggaaataaatccattcctactaagaaagccacactgcagttataaaatgtgagcctcctgtgaaagccacactcagcttttctggaggcaatgtcttcttgtttcatgtggaattgaagattttcacaaccttccactaattgacacaagtggaatttctaacctgacaaggagattaaataagcaaccttcacacagcagctgagctatctggccaaattgtcagggttcagaagagcacaaagagacacagactgataagaagcagttcaagtcatttaagagcggtgcctatagactccactattgtaaaatatattatctctggttttgtcaaatggttattgtcagtgcttgggccgatttaatcagaaacgccccacaccagttttggaaactgaacttttattcagcacacagaaatagacattctgttcccttgcttcgtgtattgttaggaaacactcacactgagaggaaaacaataacaacaacaacacaaaacaactggacccttatgatgaattttactgcaccaagaatataactggaaacaagtttttttttctctcttccttcctcccttcctcccctccctctaattatctcataggtatatatatttcaaagcccaagaatgaaggcaagatttttttttttcaattgaagtagtaacttcacaccaaacagctactctcttatcagcaaaggcagtcctcaatgtggtgatgtgttgatatgaaaacactattcattacaacttcctcttgacataatttgttgattcagtgctctgaagtacgagaaagaataaaggggaaaaatctaaaacagaaataccagccacacagaataagggttggggaactgaaatgttgataactcaggggatcaaaagactgggtcacaaatagaaatgaaaagtaagacacataatttcatgatccaagggcacacgttttgggtaaattttatgtaaaacattttaaattaaggagaagcgtattatgggggaaatctgtatttggcattgaattttaattttctctcatattaactaatgtttttattatacaaattttcaaattttcccttttcttttttgtctatttgtaaatgtcacaagaatttctaaatgtaataccaagaaaagaaaatgtgcattaaacattgctgataacctaactaataagcgttaatgaagatctatttagcctaaaatgttagggtcctgatttggcaaaacccatagtatccagctgattattcattcccatgttgacatcatttaggagagtaaagtaaagatgaagaaagagcagattaatcatagaaatacaaaatttctcttttatatgaaatctaagtaaaattcattctttatatggaaatgagtcttgcatttgggcgggcagtcatacactgcaccagaggcatagctattcatagtaatacataatgtaagcaattaaatatatgcagtggcatttaaacaaattagagcttctttggcaaatggatggatctggaggatatcattgtgagtgaggtaacccaatcacaaaagaacacacatgatatgcacccactgataagtagatattagcccagaagctcagaatacccaagatacaattcacaaaacatatgaaactcaagaagaaggaagaccaaaatgtggatacttcattccttcttagaaggggggacaaaatacccgtggaaggagttatagagacagtgtggagcagagactgaaggaatgaccatccagagactgccccaccttgtgatctatcccataaacaaccaccaaacccagacagtattgtggatgccaacaagagattgctgacaggagcctgatatagttgtctcctgagaggctctgccagtgcttgacaaatacagacgtggatgctcacagccatccattagactaagcacagggtccctaatgaaggagctagagaaagtacccaaggagctgaaggagtttgcagccccataggaggaacaacaatatgaactaacaagtttcccctgagtacccaaggactaaaccaccagtcaaataaaacacacagaaggactcatagctccagctgcatatgtagcagaggatggcctagttggtcatcaatggaaagagaggcccttggtcctgtgaaggttctaaaccccactataggggaatgccatggccaggaagtgggagtgggtgggttggtgagcagggggagggagagggtatagggggttttcaggggagaccaggaaaggggataagattttaaatgcaaataaggaaaatatctaataaaaatgaaaatatccaataaataaattagagcaagaactgaccttcaattatttttaccttgtaaatttgtttaataagcttatcaatattctaggcatctttaatattttctgatgttttgcgtgacattaaaataaatataaccactaatttcttataattaaatgagaaagaacattcacacgtggatgtcatgggactggtattgaacctttcacagttaatctagccaggtgagttaatagagagcacaccgattttctatttcaagaaaaatgtctttctgggctttggatgttgttactggctgggtttgtcagagtgaaaagtggatattaactatgatagcagaataaaggggtgaaggatgccttgccaagatgaaaataacagaaagagtatacaggatcttaaaacaagccaggatgtgagctgtacaagttttgagagctctgaggcatgttctcagtcaacctcaagggggcagtattgagcttggaattcagtatcaactcttggagaggtaatttttaatggatgggaacattacagaaagttcttgatcttatcttttttataatagaccaatcacagatgaagggcatgcctatgtaccaaatggctcatcttctctgcctgacgtacagctggcagagtttcccagagtttgtgggctgcctcttcactttatttgcagtctccattgctgaagagaagtgaaatttcattggtactcacttgtcaattattggtctggagaacccagagtcttatttagaatgtctgtctcttgaagtgtatcttctttcctttagagatttcagggcttccgggtttacactaagctgtctgataaatttgaagttgattattttttttttttttctgtatgaaagaaagggtcaggttttgttcttccatacatagaaatccagtttcctgaaaccatttgctaaaaatctgtcttttctccagggagagattttggcatttttctccattaaaaacataaggtggttagttcatattgttgttccacctatagggttgcagacccctttagctccttgggtgctttctctagtttctccattgggggccctgtgttccatccgatagctgactgtgagcatccacttctgtgttttccaggccccggcatagcctcacaagacacatatatatgagggtcctttcagcaaaatcttgctactgtatgcaatggtgttagcatttggaggctgattatgggatggatccctgggtacctccggagctcatgtctctacctgcatatatatcagaagatggcctagtcagccatcattggaaagagaggcctcttggtcttgcaaacttttttttaaaatatttttttattacgtattttcctcaattacatttccaatgctatcccaaaagtcccccataccctcccccccacttccctacccacccattcccactttttggtcctggcgttcccctgtactggggcatataaagtttgcctgtccaatgggcctctctttccagtgatggccgactaggccgtcttttgatacatatgcagctagaatcaagagctctggggtactggttagttcataatgttgttccacctatagggttgcagatccctttagctccttgggtattttctctagctcctccattgggggccctgtgatccatccaatagctgactgtgagcttccacttatgtgtttgctaggccactgcatagtctcactagagactgctatatcagggtcctatcagcacaatcttgctaatgtatgcaatggtgtcagcgtttggaggctgattatgggatggatccctggatatggcagtctctagatggtccatccttttgtctcagctccaaactttgtctctgtaactccttccatgggtgttctgttcccaattctatgaaggggcaaagtgtccacactttagtcttcgttcttcttgagtttcatgtgttttgcaaattggaacttatatcttgggtatcctaagtttctgggctaatatccacttatcagtgagtacatatcatttgagttcctttgtgattgtgttacctcactcaggataatgccctccaggtccaaccatttgcctaggaatttcagaaattcattctttttaatagctgagtagtactccattgtgtaaatgtaccacattttttgtatccattcctctgttgaggggcatctgggttctttccagcttctggctattataaaaaaggctgctatgaacatagtggagcatgtgtccttcttactggttggaacatcttctggatatatgcccaggagaggtattgcgggatcctccggtagtaccatgtccaattttttgagaaaccgccagactgatttccagagtggttgtacaagcttgcaatcccaccaacagtggaggagtgttcctctttctccatatcctcaccagcatctgctgtcacctgaatttttgatcttagccattctgactggtgtgagatggaatctcagggttgttttgatttgcatttccctgatgatgaataccgaatggctgagaaacacctgaaaaaatggtcttgcaaactttatatgccttagtacaggggaacaccagggccaagaagtgggagtgggtaggtaggggagtggggaggggtgtgtatgggggacttttgggatagaatttgaaatgtaaatgaagaaaatacctaattaaaaacaaacaaacaaacaaacaaacaaacaacaaaacatcaggtgggtatcgacacatgtgtttatttttgggtcgtctatgctagctagttgatttgcacgtgtgttgatgtcagtcctcttgtttctgttattactggtttgtcccatcaaaaactgacactggcactcaacagagcattttctttttttaaaatttttatttttaatttatttttttaactccatattccattccctgccccccatccaccctccaattgttccacatcccacacttccaccccaacccatcccaccccatgtccatgtggatgtccccacccctcaacccacttgacctctaaattttctggggcctccagtctcttgagagttaggtgcatcatctctgaacgaacacagacccagcagtcctctactctatgtgtgttggggacctcatatcagttgatgtatgctgtctgtttggtggttcggtgtttgagagatcttggaggtccagattaattgagactgctggtcctcctacaggattgccttgctccttggcttctttcagccttccctaattcaacaacagggatcagatgcttctgtccattggttaggtgcaaatatctgcatctgattcttacagctgcttgttgggtctttcggggcattcttgatagatcccttttgtgagctctccatatcctcagtaatagtgtcaggccttggaatctcccctggagctggatcctaccttgggcttgttgttgggccttcttttcctcatgctcctctccatttccatcccagtaattctttcagacagaaacaattatgggtcagaggtgtgactgtgggatggcaaccccatccctcacttgatgccctgccttcctgctggaggtgggctctgtaatttccctctccatactgtcctctagctgttcatctaaggtccctccctttgagttctgagagtctctcacttcccagggctctgatgcactctgggggggggatcccccaacatcttatttcttgagattacctgattacattatttctgttggccctaggggatttagtccttttccctcacccaataccagaccaggttcccctctacctccaactccccctccatccactatccctcccgtgtccttccctcctaccatacttgtgattgctttcttctctctcccaagtgggactgaggtgtcctcacttgggcacttcagcttgttgaggtttttgagttctatggactgtatcttggatattttgttctttttatttttattatttttattttttgctaatatctacttattagtacataccatgcatgtccttttgggtctgagttacctcacttgggatgatattttctagttccatccatttgtttgcaaaactcaggatttcctcattcttgatagctgagtattattccattgtgtaaatgaaccacattttctgtatctgttcttctgttgtgggacatctaggtaatttccaacttctggctatcacaaataacgccattatgaacatagtggaacatgtgctcctgtggcatggtggggcatctcttgggtgcattcccaagagtggtacagctgggtcttcaggtagatctatttccaattttctgaggaacctccagattgatttccaggttgtttgtcccagtttgccatcccaccagcaatggaggtgtgttcctatttcttcacatcctctccaacatttgctatcacttgagggtttgatcttagccaatctgattggtgtaaactggaatctcagggtcattttgatatgcatttctctgatcatttgaacattttctcaaccattcccaattcttcagttgtgaattctcaatttagttctataccccatttttattagatattttcttcatttacatttcaaatgctatcccattttctagtttcctttccaaaagtcccctataacccccctacctcccgccctgctccccaacccacccactccattttttgattgagatgtttggtttttcggtgattaacttcttgagttggattcggggttagtgaatattttttttccaatctaagttgccaatttgtcttattgactatgtcctttgccttacagaagctttccagtttcatgaggtcccatttatcaattgttgatcttagagcatgagccactgtagttctgtttaagcaatttccccctgtacctatttgttcaaggctctttcccactttctctcctattagattcagtgtacctggttttatgttgaggtccttgatccacttgaacttgagctttgtacaaggtgacaaatatgggtctattttcattcttctacatatagacagccagctagaccagcaccatttattgaagatgctttcttttttccattgtatatttttggtgtctttctcaaagatcaagtaaccttaagtgtgtggttttatttctgggtcttcagttcttttccattgatcaacatgtctgtctctgtgccaataccatgcagtttttatcactattgctctgtaataaagcttgaagtcagggatggtgattcccccagctgctctcttattgttaaaatttgtttccactattatgggtatttgcctttccagatgaatttaagaattgttctttccatgtctttgaagaattgtgttgggattttgattgggattgcattggatctatagattacctttggtaggatggccatttttactatgttaattttgccaatccataaccatgacaagtttatacattttctaagatcttcttcgatttctttcttgagagacttggaattattttcatacaggtcttccacttgtttggttagagttactccaagatattttattctatttgtggctattgtgaatggaatttttaccctaacttctttctcagcctgtttatcctttgtataaaggaaggctactgatttatttgagttaattttatatccattcactttgctgaagttgtttatcagctggagaagttctctggtagaatttatgtataccatcatatcatctgcaaatagtgataccttcacttcttctttaccaatttgtatccctttgatcactttttttctgtcttattgttctaactaacacttcaagtactatattgaatagatatggggagagtgggcatccttgtcttgtccctgattccagtgggattgtttcaagtatgtgtcagtttaatttgatattggttgttggtttacagtaaattgcttttattatgtttaggtatgggccctgaattcctgatctctccaatactttttaacatgaagaggtattgtattttgtcaaatgttttttctggatcttaagagatgatcatgtgatatttttctttaagtttgtttatagagtggattgcaataatgaattttcatatattaaaccaaccttgcatcactgggatgaagcctacttgatcatggtgaattatggttttgatgtgttcttgaattcggtttgctaggattttattgagtatttttgcattgatattcataagtgagattggtctgaagttctcttttttggttgggccctgtgtgatttaagtatcagagtaattgtggcttcatagaacaagttaggttgtgctaattctgtttctattttatggaatagtttgaggaaaacttgtatcaggtcttctttgaaggtctggtagaattctgtactaaatccatttggccctgggcttttttttggttgggagatttttaatgacttcttctatttccttgtgtgatatgggcctatttagataatttacctgttcttgatttaactttgacatgtgtcatctgtctagaaaaccattcatttcatttaggttttccagttttgttgagtatagactattatagtaggatctgatcctccatttctgttgttatgtatcccttttcatttctgattttatgaatttggatactgcctcttggccctttagttagtttggctagtggtttacctatcttgttgattctttcaaaggatcagcctttggttttgctgatttttgtattgttttctttgtttatatttggttgattttggccctgagtttgactatttcccaccttctactcctctgagtacctttgtttctttttgttctagagctatcagatgtggtgttaagttgttagtgtaagatctcttcagtttctttacccaggcacttagtgttgtgtactttcttctt

SEQ ID NO: 12 - DNA, 25396 bp, Mus musculus
aagaagaaagtacacaacactaagtgcctgggtaaagaaactgaagagatcttacactaacaacttaacaccacatctgatagctctagaacaaaaagaaacaaaggtactcagaggagtagaaggtgggaaatagtcaaactcagggccaaaatcaaccaaatataaacaaagaaaacaatacaaaaatcagcaaaaccaaaggctgatcctttgaaagaatcaacaagataggtaaaccactagccaaactaactaaagggccaagaggcagtatccaaattcataaaatcagaaatgaaaagggatacataacaacagaaatggaggatcagatcctactataatagtctatactcaacaaaactggaaaacctaaatgaaatgaatggttttctagacagatgacacatgtcaaagttaaatcaagaacaggtaaattatctaaataggcccatatcacacaaggaaatagaagaagtcattaaaaatctcccaaccaaaaaaaagcccagggccaaatggatttagtacagaattctaccagaccttcaaagaagacctgatacaagttttcctcaaactattccataaaatagaaacagaattagcacaacctaacttgttctatgaagccacaattactctgatacttaaatcacacagggcccaaccaaaaaagagaacttcagaccaatctcacttatgaatatcaatgcaaaaatactcaataaaatcctagcaaaccgaattcaagaacacatcaaaaccataattcaccatgatcaagtaggcttcatcccagtgatgcaaggttggtttaatatatgaaaattcattattgcaatccactctataaacaaacttaaagaaaaatatcacatgatcatctcttaagatccagaaaaaacatttgacaaaatacaatacctcttcatgttaaaaagtattggagagatcaggaattcagggcccatacctaaacataataaaagcaatttactgtaaaccaacaaccaatatcaaattaaactgacacatacttgaaacaatcccactggaatcagggacaagacaaggatgcccactctccccatatctattcaatatagtacttgaagtgttagttagaacaataagacagaaaaaaagtgatcaaagggatacaaattggtaaagaagaagtgaaggtatcactatttgcagatgatatgatggtatacataaattctaccagagaacttctccagctgataaacaacttcagcaaagtgaatggatataaaattaactcaaataaatcagtagccttcctttatacaaaggataaacaggctgagaaagaagttagggtaaaaattccattcacaatagccacaaatagaataaaatatcttggagtaactctaaccaaacaagtggaagacctgtatgaaaataattccaagtctctcaagaaagaaatcgaagaagatcttagaaaatgtataaacttgtcatggttatggattggcaaaattaacatagtaaaaatggccatcctaccaaaggtaatctatagatccaatgcaatcccaatcaaaatcccaacacaattcttcaaagacatggaaagaacaattcttaaattcatctggaaaggcaaatacccataatagtggaaacaaattttaacaataagagagcagctgggggaatcaccatccctgacttcaagctttattacagagcaatagtgataaaaactgcatggtattggcacagagacagacatgttgatcaatggaaaagaactgaagacccagaaataaaaccacacacttaaggttacttgatctttgagaaagacaccaaaaatatacaatggaaaaaagaaagcatcttcaataaatggtgctggtctagctggctgtctatatgtagaagaatgaaaatagacccatatttgtcaccttgtacaaagctcaagttcaagtggatcaaggacctcaacataaaaccaggtacactgaatctaataggagagaaagtgggaaagagccttgaacaaataggtacagggggaaattgcttaaacagaactacagtggctcatgctctaagatcaacaattgataaatgggacctcatgaaactggaaagcttctgtaaggcaaaggacatagtcaataagacaaattggcaacttagattggaaaaaaaatattcactaaccccgaatccaactcaagaagttaatcaccgaaaaaccaaacatctcaatcaaaaaatggagtgggtgggttggggagcagggcgggaggtaggggggttataggggacttttggaaaggaaactagaaaatgggatagcatttgaaatgtaaatgaagaaaatatctaataaaaatggggtatagaactaaattgagaattcacaactgaagaattgggaatggttgagaaaatgttcaaatgatcagagaaatgcatatcaaaatgaccctgagattccagtttacaccaatcagattggctaagatcaaaccctcaagtgatagcaaatgttggagaggatgtgaagaaataggaacacacctccattgctggtgggatggcaaactgggacaaacaacctggaaatcaatctggaggttcctcagaaaattggaaatagatctacctgaagacccagctgtaccactcttgggaatgcacccaagagatgccccaccatgccacaggagcacatgttccactatgttcataatggcgttatttgtgatagccagaagttggaaattacctagatgtcccacaacagaagaacagatacagaaaatgtggttcatttacacaatggaataatactcagctatcaagaatgaggaaatcctgagttttgcaaacaaatggatggaactagaaaatatcatcccaagtgaggtaactcagacccaaaaggacatgcatggtatgtactaataagtagatattagcaaaaaataaaaataataaaaataaaaagaacaaaatatccaagatacagtccatagaactcaaaaacctcaacaagctgaagtgcccaagtgaggacacctcagtcccacttgggagagagaagaaagcaatcacaagtatggtaggagggaaggacacgggagggatagtggatggagggggagttggaggtagaggggaacctggtctggtattgggtgagggaaaaggactaaatcccctagggccaacagaaataatgtaatcaggtaatctcaagaaataagatgttgggggatcccccccccagagtgcatcagagccctgggaagtgagagactctcagaactcaaagggagggaccttagatgaacagctagaggacagtatggagagggaaattacagagcccacctccagcaggaaggcagggcatcaagtgagggatggggttgccatcccacagtcacacctctgacccataattgtttctgtctgaaagaattactgggatggaaatggagaggagcatgaggaaaagaaggcccaacaacaagcccaaggtaggatccagctccaggggagattccaaggcctgacactattactgaggatatggagagctcacaaaagggatctatcaagaatgccccgaaagacccaacaagcagctgtaagaatcagatgcagatatttgcacctaaccaatggacagaagcatctgatccctgttgttgaattagggaaggctgaaagaagccaaggagcaaggcaatcctgtaggaggaccagcagtctcaattaatctggacctccaagatctctcaaacaccgaaccaccaaacagacagcatacatcaactgatatgaggtccccaacacacatagagtagaggactgctgggtctgtgttcgttcagagatgatgcacctaactctcaagagactggaggccccagaaaatttagaggtcaagtgggttgaggggtggggacatccacatggacatggggtgggatgggttggggtggaagtgtgggatgtggaacaattggagggtggatggggggcagggaatggaatatggagttaaaaaaataaattaaaaataaaaattttaaaaaaagaaaatgctctgttgagtgccagtgtcagtttttgatgggacaaaccagtaataacagaaacaagaggactgacatcaacacacgtgcaaatcaactagctagcatagacgacccaaaaataaacacatgtgtcgatacccacctgatgttttgttgtttgtttgtttgtttgtttgtttgtttttaattaggtattttcttcatttacatttcaaattctatcccaaaagtcccccatacacacccctccccactcccctacctacccactcccacttcttggccctggtgttcccctgtactaaggcatataaagtttgcaagaccattttttcaggtgtttctcagccattcggtattcatcatcagggaaatgcaaatcaaaacaaccctgagattccatctcacaccagtcagaatggctaagatcaaaaattcaggtgacagcagatgctggtgaggatatggagaaagaggaacactcctccactgttggtgggattgcaagcttgtacaaccactctggaaatcagtctggcggtttctcaaaaaattggacatggtactaccggaggatcccgcaatacctctcctgggcatatatccagaagatgttccaaccagtaagaaggacacatgctccactatgttcatagcagccttttttataatagccagaagctggaaagaacccagatgcccctcaacagaggaatggatacaaaaaatgtggtacatttacacaatggagtactactcagctattaaaaagaatgaatttctgaaattcctaggcaaatggttggacctggagggcattatcctgagtgaggtaacacaatcacaaaggaactcaaatgatatgtactcactgataagtggatattagcccagaaacttaggatacccaagatataagttccaatttgcaaaacacatgaaactcaagaagaacgaagactaaagtgtggacactttgccccttcatagaattgggaacagaacacccatggaaggagttacagagacaaagtttggagctgagacaaaaggatggaccatctagagactgccatatccagggatccatcccataatcagcctccaaacgctgacaccattgcatacattagcaagattgtgctgataggaccctgatatagcagtctctagtgagactatgcagtggcctagcaaacacataagtggaagctcacagtcagctattggatggatcacagggcccccaatggaggagctagagaaaatacccaaggagctaaagggatctgcaaccctataggtggaacaacattatgaactaaccagtaccccagagctcttgattctagctgcatatgtatcaaaagacggcctagtcggccatcactggaaagagaggcccattggacaggcaaactttatatgccccagtacaggggaacgccaggaccaaaaagtgggaatgggtgggtagggaagtgggggggagggtatgggggacttttgggatagcattggaaatgtaattgaggaaaatacgtaataaaaaaatattttaaaaaaaagtttgcaagaccaagaggcctctctttccaatgatggctgactaggccatcttctgatatatatgcaggtagagacatgagctccggaggtacccagggatccatcccataatcagcctccaaatgctaacaccattgcatacagtagcaagattttgctgaaaggaccctcatatatatgtgtcttgtgaggctatgccggggcctggaaaacacagaagtggatgctcacagtcagctatcggatggaacacagggcccccaatggagaaactagagaaagcacccaaggagctaaaggggtctgcaaccctataggtggaacaacaatatgaactaaccaccttatgtttttaatggagaaaaatgccaaaatctctccctggagaaaagacagatttttagcaaatggtttcaggaaactggatttctatgtatggaagaacaaaacctgaccctttctttcatacagaaaaaaaaaaaaaataatcaacttcaaatttatcagacagcttagtgtaaacccggaagccctgaaatctctaaaggaaagaagatacacttcaagagacagacattctaaataagactctgggttctccagaccaataattgacaagtgagtaccaatgaaatttcacttctcttcagcaatggagactgcaaataaagtgaagaggcagcccacaaactctgggaaactctgccagctgtacgtcaggcagagaagatgagccatttggtacataggcatgcccttcatctgtgattggtctattataaaaaagataagatcaagaactttctgtaatgttcccatccattaaaaattacctctccaagagttgatactgaattccaagctcaatactgcccccttgaggttgactgagaacatgcctcagagctctcaaaacttgtacagctcacatcctggcttgttttaagatcctgtatactctttctgttattttcatcttggcaaggcatccttcacccctttattctgctatcatagttaatatccacttttcactctgacaaacccagccagtaacaacatccaaagcccagaaagacatttttcttgaaatagaaaatcggtgtgctctctattaactcacctggctagattaactgtgaaaggttcaataccagtcccatgacatccacgtgtgaatgttctttctcatttaattataagaaattagtggttatatttattttaatgtcacgcaaaacatcagaaaatattaaagatgcctagaatattgataagcttattaaacaaatttacaaggtaaaaataattgaaggtcagttcttgctctaatttatttattggatattttcatttttattagatattttccttatttgcatttaaaatcttatcccctttcctggtctcccctgaaaaccccctataccctctccctccccctgctcaccaacccacccactcccacttcctggccatggcattcccctatagtggggtttagaaccttcacaggaccaagggcctctctttccattgatgaccaactaggccatcctctgctacatatgcagctggagctatgagtccttctgtgtgttttatttgactggtggtttagtccttgggtactcaggggaaacttgttagttcatattgttgttcctcctatggggctgcaaactccttcagctccttgggtactttctctagctccttcattagggaccctgtgcttagtctaatggatggctgtgagcatccacgtctgtatttgtcaagcactggcagagcctctcaggagacaactatatcaggctcctgtcagcaatctcttgttggcatccacaatactgtctgggtttggtggttgtttatgggatagatcacaaggtggggcagtctctggatggtcattccttcagtctctgctccacactgtctctataactccttccacgggtattttgtccccccttctaagaaggaatgaagtatccacattttggtcttccttcttcttgagtttcatatgttttgtgaattgtatcttgggtattctgagcttctgggctaatatctacttatcagtgggtgcatatcatgtgtgttcttttgtgattgggttacctcactcacaatgatatcctccagatccatccatttgccaaagaagctctaatttgtttaaatgccactgcatatatttaattgcttacattatgtattactatgaatagctatgcctctggtgcagtgtatgactgcccgcccaaatgcaagactcatttccatataaagaatgaattttacttagatttcatataaaagagaaattttgtatttctatgattaatctgctctttcttcatctttactttactctcctaaatgatgtcaacatgggaatgaataatcagctggatactatgggttttgccaaatcaggaccctaacattttaggctaaatagatcttcattaacgcttattagttaggttatcagcaatgtttaatgcacattttcttttcttggtattacatttagaaattcttgtgacatttacaaatagacaaaaaagaaaagggaaaatttgaaaatttgtataataaaaacattagttaatatgagagaaaattaaaattcaatgccaaatacagatttcccccataatacgcttctccttaatttaaaatgttttacataaaatttacccaaaacgtgtgcccttggatcatgaaattatgtgtcttacttttcatttctatttgtgacccagtcttttgatcccctgagttatcaacatttcagttccccaacccttattctgtgtggctggtatttctgttttagatttttcccctttattctttctcgtacttcagagcactgaatcaacaaattatgtcaagaggaagttgtaatgaatagtgttttcatatcaacacatcaccacattgaggactgcctttgctgataagagagtagctgtttggtgtgaagttactacttcaattgaaaaaaaaaaatcttgccttcattcttgggctttgaaatatatatacctatgagataattagagggaggggaggaagggaggaaggaagagagaaaaaaaaacttgtttccagttatattcttggtgcagtaaaattcatcataagggtccagttgttttgtgttgttgttgttattgttttcctctcagtgtgagtgtttcctaacaatacacgaagcaagggaacagaatgtctatttctgtgtgctgaataaaagttcagtttccaaaactggtgtggggcgtttctgattaaatcggcccaagcactgacaataaccatttgacaaaaccagagataatatattttacaatagtggagtctataggcaccgctcttaaatgacttgaactgcttcttatcagtctgtgtctctttgtgctcttctgaaccctgacaatttggccagatagctcagctgctgtgtgaaggttgcttatttaatctccttgtcaggttagaaattccacttgtgtcaattagtggaaggttgtgaaaatcttcaattccacatgaaacaagaagacattgcctccagaaaagctgagtgtggctttcacaggaggctcacattttataactgcagtgtggctttcttagtaggaatggatttatttccattaattaatttatttattcactttatatcccaattatacccccttcccagtcctcccctcacacagcccttccctgcattgcctctccccttcttttctgagagagtggcagctacccttgatattccccccatcctggcagatcaagtcattgcatttttttaacccggtgttcagctggttcctgtccttatttaactgatattagagtgatgttctgccatttgtaaaagagcttgcagagtttgattgctggtttgcatttagagtcacttcttaactgggggctttctactaaaggcacttagtaaagacataaagacataatactttaccaggtcactttcagttttttgcagttgaatagattgtgatggactgtatgaatgtgggtgacttccagtaaaaacacactctctctctctctctctctctctctctctctcacacacacacacacacacacacacacacacacacacacacacacacacaccctaaaatgtctcaccatacccatgcataattattgcatgcactatgagaaaagacagaagaatgcctcatctacaaaactaccttgggaggatgtcaacattagcactactagctgctagtctatctatatacgaaacattcatatacacagttacatctgctctaacacatgtcttttgcctccttgatgacaactgttccaaaagaaaacagtgatatctcttgatatgttttgatttgcattgccctaatattgagttctttttcataaatgtgttagaaatttgtgtgacttcttttgaaaaaaaatatatctgttttcttcctttttgtgttccatgttctttctagtgggttgcatgggttccttacacactttgcatagtgatccactgttggatattagttcacaaatactttctcccattttaaattaactatcattttgttgattattctccatgctatgcaaaaactttattagtcacatttgacttgtccatttttgtccttcttatctgagcttttcctttaaaatgttgaatgtggctgttgtctattaaaacaaacctttcaccgtgtatcctaggcagactttatggttgtgcctcaggttctcaagggctggcaacacaggcatgcactacaaacctggttcacagccaatattaataaattttgctcttcttttcattctagatattttgcacttttatatcttaaggctttggttcgttttttagttaaaggcgacagtttaatttgatttcattttgatggcttatcctgtaatctcataattggtctctaactattcatatgtatcatatgtattactccaacaacattaccttgtagttcaggataaggaacacttgaaactcatattttgtctccagaatttagcatgagacaagtgcttaaagagtgggaaactgtgaacatgaagtgttgccaagaataatacaaacaattataaaaccaggaggggaaacaacagagaccagtccaaagagagtccaatctccatgtccttagtggatattcaagacagacacactaggggaaatggacttctctttgctatgagcccatgaaaacttcctatgtctgcaaaggctatcaaagaacaaaacatttctgctcatattttccatagtccttatttaccccttattattgcctcctgttctctagttcaagttgtgagtatgtgaagtttcattatcattgttaatgggagaggctgggtaccagggctcaagagctcctgggtttcctcttcaagcatatctctgtaacacagtggggttttctaagataacagaggtcaggagaaaatggataatgttcatagaaaagcaagcaaggaagacacccttgaatagtaatcaaggcccttggtcctgtgaaggctctacgccccaatataggggaatgccaggaccaggaatgggagtgggtgggttggggagcagggggaggggagaggggagaggggatttttggaggggaaactaggaaaggggataaaatttgaaatgtaaataaagaaaataataaaaaagaaaaaatatatttgatatatattttagatagatagatagatagatagatagatagatagatagatagatagatacatagatagatacatagatagatacatagatagatagatagataaaagaaaagagtgatggatacttgaggcaagagaaattagactaaagtctctgagatactagacaacaagcagaaaatcaaggggcatttgtgaggaaaaattagaacaatacaaaaaactataaaacatagtatatgtctatgctgtaaattaaacccctatttaacttctttttctgagaaatggatgtcagggaaggttgctgacggaatagccacttactatctcaccacttatcacaaagctgcagaagtcaattaccaggaagtcaaagtgaataccttgtttctgaactctcacttcctctttggtattttattcttgaatggttttaactgaaatagaatggcatgacttttaccctcacttccttccctccagcatgccccaactgctttatataataaatatttcacattaatccttgcaagaaacaaaagtaatcaaaacacagaattgagatgacagtaaatatcatttattagataaaagctagatgcccaaaggtcttcatcatttccccacaattgacagtttttctctaggggacatataacctttgtgcatagacaatagcagaaaaggggcttagtggtacttgtgagccagggcagcagccactccagccaccaccttctggaaggcagcctgtgcagcgggggtgaaatccttgcccaggtggtggcccagcacaatcacgatcatattgcccaggagctgtgggaagatggaagaaccatcaacataactgtagagcaaaaataccagatactgcaggcttatttataaagacatttgtttgcaaccttaaactgctgacaaattattataagaatcctatgtcaaacagaatttatatgtaaaatatattcttcccctgtcaccctggcataaaagccaattatgctactattcttgagagctatgagaagaaacagggacatatcttccttgtcctctgagtaagttacaaggcaatatttaaaaagacaaacaaaagtagatcaaagaagaagaaatgaactgagggaaaggaaaggattagagaaagagagaggagagagagaaggactgggaggaaaggaggaggggaagctgatatcaggatgggaagtaaataaccagcttaattaatttagtaaaatgcaactggaaattaaaagcttaccaaagaaagaggaaatgacaacacagaacagagtgagggggagcagcgattctgagtagagaataaaatatccaaactcttgtcaacactccacacacagtcatggagactgctccctagaatcgcttcccctttccttctgataggaaggttgagcagaatagccaggggaaggaaacccaggaggtgcccatcagactcaccctgaagttctcaggatccacatgcagcttgtcacagtggagctcactgaggctggcaaaggtgcccttgaggctgtccaagtgattcaggccatcgttaaaggcagttatcactttcttgccatgggccttcactttggcattacccatgatagcagaggcagaggataggtctccaaagctatcaaagtaccgctgggtccaagggtagacaaccagcagcctaaaaagggaaacatagacaggggacactcaaagttagtgcctgctggaaagcagacctctgtctccaagcacccaacttctacttgtgagctgccttgtaacctggataccaacctgcccagggcctcaccaccaacttcatcggcgttcacctttccccacaggccagagacagcagccttctcagcatcagtcaggtgcaccatgatgtctgtttctgaggttgcaagtcaacacaacagaatcagaagcaaacgtaagaagcaactgaccctgctcagctttatatacccaatgctggctcctgcccactctgtcctctctgagcagattggccaatgccagggtgttaccctgcagggtgaggcttcagagatgacaaccatatctacacagggtggctatggcccaggcttaagacatttgagttctgggtctcactctgagtagtgtctgttcttatccttgcagctaattctgtttctataacatcttctttaaatactgtatttttcaattcttgcaccaataacatagcttgtctgttcaatattatctcttcaatattgtttactacacaaataaaaaattaaaacacattatacataagaaaatttgcctgttctgttttgttttgatctgggtatgttggttcgttttcttttagtttgagtgcacaagaggatcaccccaattatggaacataagaaaagaagacaaaataatcatttttctattgtttttctaactatttttcttcatgttttgaagaaaccttcaggtaggaaaataaatatatattcatttctttcatacttgtttggtttgtttccttcattctttaatttgttaatttagtcacatgatttatgggaagtagcacacaagtgaattgatcacgtcttggacattgctctctcttttagtttttgggagccagagaaggaaacacagaactctcaatttggaaaaaataaaaaagaaatacaaagctacttataaccctaagattagtggcaatattcagagataaagaaagagggagggaaagaagtgagaaaggttttcctagtgacaggtaaacccagtgaagggatcttgaaagatattctccctgtgttaagtgttgaagagttttcttcctctctctctctctctctctctctctctctctctctctctctctctctctctctctctctctctctctctctccttctctcactaattcagtcgctcattctgctgcttcctgggcactgtgtatactgcatatgttttagaatcatttttttacttcatagtccccacctattcccatttgtactctatatttttcattactcttaaattatttaattttatcttcattccttttcaatcttgttttgtcctctaaactctcacataaaatgtcctaaacttttcatgctaagaacttctggtgtgcttttccttcttggtattaaaaaccatgggaagccttaaataagctctgaggttcacacaaggagaaggtacaaaagtgggaggagaaggacctgggaagagaagcttctgtgtgagatgatgagggaggcacttagggatgagaatgactcagggcatgaaagagatatgtgaaaataagaagggaacttcccctgtgaagggaagaagcaacatgcactactgagtagtgaattacctcagctcgctctctctctctctctctctctctctctctctctctctctctctctctctctctctctctcgctctctctctctctctctctctctctctctctctctctctcctttctctctctctcctttctctctctctctcctttctctctctctctcctttctctctctctcctctctctctcctttctctcactctcctttctctctctcatctccctctctctttctctttctctttctccctccttccctcactccctccctccctccctccctccctccctccctccctccctccctctctccctctctgtgagcccctatgaatcctgcttacttgtttagtcagtctgttctcacagagtccttaatacctgactcctacaattcttcctcgtcctcttccttgggatccagctgctctgcctagtgtttggctgtgggtctctgtgtctgctcctatccgttgctggatgatgatctccaacgataactgaactgggcaccaatcaatcaatgagtacatgagaatatcatcaggcatcatttcattgactttttaaaaaaagtttttgcctgtcttgttcaatcatgggtctctaggctgaatacctctggttcttacatcctgactaatttttctttttcattttttattaggtatttagctcatttacatttccaatgctataccaaaagtcccccataccgacccacccccactcccctacccacccactccccctttttggccctggcgttcccctgtactggggcatataaagtttgcgtgtccaatgggcctctctttacagtgatggccgactaggccatcttttgatacatatgcagctagagtcaagaactccagggtactggttagttcataatgttgttccacctggggggttgcagatccctttagctccttgggtactttctctagctcctccattgggagccctgtgatccatccacctgctgactgtgatcattcactcctgtttttgctaggccccggcataatctcacaagagacagctacatctgggtcctttcgataaaatcttgctagtgtatgcaatggtgtcagcgtttggatgctgattatggggtggatccctggatatggcaatcactagatggtccatcctttcgtctcagctccagactttgtctctgtatctccttccatgggtgttttgttctcacttctaaggaggggcatagtgtccacacttcagtcttcatttttcttgagtttcatgtgtttaggaaattgtatcttatatcttgggtatcctaggttttggactaatatccagttatcagtgagtacatattgtgtgagttcctttgtgaatgtgttacctcactcaggatgatgccctccaggtccatccatttggctaagaatttcataaattcattctttttaatagctgagtagtactccattgtgtagatgtaccacattttctgtatccattcctctgttgagggggatctgggttctttccagcttctggctattataaataaggctgctatgaacatagtggagcatgtgtccttcttaccagttggggcatcttctggatatatggccaggacaggtattgcgggatcctctggtagtactatgtccaattttcagaggaaccgccagactgatttccagagtggttgtacaagcttgcaatcccaccaacaatggaggagtgttcctctttctccacatccacttcagcatctgctgtcacctgaatttttgatcttagccagtctggttggtgtgaggtagaatctcagggttgttttgatttgcatttccctgatgattaaggatgttgaacattttttcaggtgcttctctgccattcgatatccctcaggtgagaattctttgttcagttctgagccccatttttaaatggggttatttgattttctgaagtccaccttcttgagttctttatatatgttggatattagtcccctatctgatttaggataggtaaagatcctttcccaatctgttggtgttctttttgtcttattgacggtgtcttttgccttgcagaaactttggagtttcattaggtcccatttgtcaattcttaatcttacagcacaagccattgctgttctgttcagaaattttttccctgtgcccatatcttcaaggcttttccccactttctcctctataagtttcagtgtctctggttttatgtgaagttccttgatccatttagatttgactttagtacaaggagataagtatggatcgattcgcatccttctacatgataacaaccagttgtgccagcaccaattgttgaaaatgctgtctttcttccactggatggttttagctcccttgtcaaagatcaagtgaccatagatgtgtgggttcacttctgggtcttcaattctattccattggtctacttgtctgtctctataccagtaccatgcagtttttatcacaattgctctgtagtaaagctttaggtcaggcatggtgattccaccagaggttcttttatccttgagaagagtttttgctatcctaggttttttgttattccagatgaatttgcaaattgttccttctaattcgttgaagaattgagttggaattttgatagggattgaattgaatctgtagattgctttttgcaagatagccatttttacaatgttgatcctgccaatccatgagcatgggagatctttccatcttctgagatcttctttaatttctttcttcagagacttgaagtttttatcatacagatctttcacttccttagttagagtcatgctgagatattttatattatttgtgactattgaaaagggtgttgtttccctaatttctttctcagcctgtttattctttgtgtagagaaaggccattgactagttttagtttattttatattcagctacttcaccgaagctgtttatcaggtttatgagctctctggtggaatttttagggtcacttatatatatactatcatatcatctgcaaaaagtgatattttgacttcctcttttccaatttgtattcccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggcatgggccttgaattcctgatctttccaagacttttatcatgaatgggtgttggatcttgtcaaatgctttttctgcatctaatgagatgatcatgtggtttttgtctttgagtttgcttatataatggattacattgatggatttttgtatattaaaccatccctgcatccctggaataaaacctacttggtcaggatggatgattgctttaatgtgttcttggattcggttggcgagaattttattgaggatttttgcatcgatatttataagggaaattggtctgaagttctctatctttgttggatctttctgtagtttaggtatcagagtaattgtggcttcataaaatgagttgggtagagtaccttctacttctattttgtgaaatagtttgtgcagaactggaattagatcttctttgaaggtctgatagaactctgcactaaacccatctggtcctgggctttttttggctgggagactattaataactgcttatatttctttaggggatatgggactgtttagatggtcaaattgatcctgattcaactttggtacctggtatctgtccagaaatttctccgtttcgtccaggttttccagttttgttgagtataaccttttgtagaaggatctgatggtgttttggatttcttcaggatctgttgttatgtctcccttttcatttctgattttgttaattaggattttgtcgctgtgccctctagtgagtctagctaagggtttatctatcttgttgattttctcaaagaaccaactcctcatttggttaattctttgaatagttcttcttgtttccacttggttgatttcacccctgagtttgattatttcctgccatctactcctcttgcgtgaatttgcttcctttttttctagagcttttagatgtgttgtcaagctgctagtatgtgctctctcccgtttcttcttggaggcactcagagctatgagtttccctcttagaaatgctttcattgtgtcccataggttttggtacgttgtagcttcattttcattaaactctaaaaagtctttaatttctttctttattccttccttgaccaaggtatcattgagaagagtgttgttcagtttccacgtgaatgttgactttccattatttatgttattgttgaagatcagtcttaggctgtggtggtctgataggatgcatgggacaatttcaatacttttgtatctgttgaggcctgttttgagacctattatatggtcaattttggagaaggtcccgtgaggtgctcagaagaaggtatatccttttgttttaggataaaatgttctgtagatatctgtcacgtccatttgtttcataacttctgttagtttcactgtgtccctgtttagtttctgtttccacgatctgtccattgatgaaagtggtgtgttgaagtctcccactactattgtgtgaggtgcaatgtgtgctttgagctttactaaagtatctttaatgaatgtggctgcccttgcatttggagcgtagatattcagaattgagagttcctcttggaggtttttacctttgatgagtatgaagtgtccctccttgtcttttttgataactttgggttggaagtcgattttatccgatattagaatggctactccaccttgtttcttcagaccatttgcttggaaaattgttttccagcctttcactctgaggtagtgtctgtctttttccctgagatgggtttcctgtaagcagcagaatgttgggtcctgtttgtgtagccagtctgttagtctatgtctttttattgggaaattgagtccattgatattaagagatattaaggaaaagtaattgtttcttcctattatttttgttgttagagttggcattctgttcttgtggctgtcttctttttggtttgttgagggattactttcttgcttgttctagggcgtgatttctgtccttgtattgcttcttttctgttattatcctttgaagggctggattcgtggagagataatgtgtgaatttggttttgttgtggaatacgttggtttctccatctatggtaattgagaatttggccgggtatagtagcctgggctggcatttgtgttctcttagtgtctgtataacatctgtccaggctcttctggctttcatagtctctgtgaaaagtctggtgtaattctgataggccttcctttatatgttatttgacctttctcccttactccttttaatattctctctttatttagtgcatttgttgttctgattattatgtgttgggaggaatttcttttctggtccagtttatttggagttttgtaggcttcttgtatgatcatgggcatctctttctttatgtttgggaagttttcttctattattttgttgaagatattagctggccctttaagttgaaaatcttcattctcatcaactcttattatccgtaggtttggtcttctcattgtgtcctggatttcctggatattttgagttaggatccttttgcattttgtattttctttgactgttgtgttgatgttctctatggaatcttctgcacctgagattctctcttccatttcttgtattctgttgctgatgctcgcatctatggttccagatctctttcctagggtttctatcttcagcgttgccttgctttgggttttctttattgtatctacttccctttttagttctagtatggttttgttcatttccatcatctgtttggatgtgttttcctgtttttctttaaggacttctacctgtttggttgtgttttcctgcttttctttaagggcctgtaactctttagcagtgctctcctgtaattctttaagtgatttgagaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcaccatctggtaatctctgaagctagctgttatagttgtctctggtaagagcttgttcttcaggtgactctgttagcctctataagcagacctgggaggctagctctctccttaatttcagtgggcagagtattctctgcaggcaagctctcttcttgcagggaaggtacccagatatctgttgttcgaacctgcctcctggcagaaattgtgttccactcactagaggtcttaggatcccgttgggaatcctgtgtgggctcttgcgggtgtcaggcgattccgatggcaaggcactccagtgctcgagtggagtggaagggacttgtggcccgggtcaggcccgggtagtctgcttccctatttcctgcagtctcaggttccgctcgattggattgtggcagacgctgtgttccactcaccagaggtcttaggatcccgtggggaatcctgtgtgggcccttgcgggtgttggtcgactccgctggcgaggtatcccggtgctcgagaggggcgggagggacttgtgctgcctgatttttatgaagattttagtatgctcaggaatgtaagattaagattcttgaagtgaatctggagtagttctgtatctgtcctacaagcctgtgatgtattgggacttccccagaagtgaagaggtctcagtacctatgcacagctccatgtacaggaaaaaatagatggatataagagagcatttgcactcagcctgacacaacaaaccatctatacacatccatatatgtgtgcaataatactgatgaaaagagaatttgaaggagagttgtgagagttatttgaggttgtttggggatagagaggaggaagaaacattataattaaattataatctcaaaaacaaagaaacaaaagctataaaataaacataacatattcagtgtagtttgttatttatacatgtcagtgtataacagcagagttactatgaatgtacactggcacagatcattgttatgttctgtttaccaggtaaataaaaaaacaataggaacacagtataaatataaataaatctatacaaattagaatctcttaaagccctcataacttcatatatgacaagaatggtggcgaaatgagcagttctgcttactgggaaggcttctgtgatggtttcctgtgtactacttcactggctactgtagtatttatgttagagctgcaatatggttgatggtattattcctcagattaaactccagccacaaaagttttaagaccacctaagtacttctgtgattataaaaagaagtggccatatcagcctaatttagccttgtatataagggagactatgagatagatgattcttgggtttttgaaagtctcagttctgatcatgatttcttttcaatatttttatctgtgtgaaatgacaatcaaaattgttaactagcctaaacatgtacctccatcaaataattaactctttcatcttgaaaatgtaattatcagtttataattgattaaaatatatttttacattatacataaaaacttataaagtgtataatatggttttagacagaactataaactagcttataacactgccactatcgttcctaaggagaaaatcacatagacttccaggttcttatcacatatcaccatagattcaacagtcaaggaaagctgtctgaaagctgtggtttttttttttttttttttttttttttttttttttttttgacagtgaagaaatgttttattcttcattcatagaattgctattttaaaaataactgtatgaacaatggtatcaaaaggcatgttaacctggattagtggaggtggatttctttttttttttaatattttttattacatattttcctcaattacatttccaatgctatcccaaaagtcccccatacccttgtgtgtacattgctgagtaaagtgacgattgcatacgctgtgatgattgatggctgtcaagatatgagactccttttctttctttttttttcttggggggggcaggaggtttgagacagggtttctctgtgtagccctggctgtcctggatcacactctgtagaccaggctggcctcaaactcagaaatctgcctgcctctgcctcccgagtgctgggattaaaggagtgtgccaccaacgcctggcatgagactccttttcatataaatgataaattatacctcatatttcagaccaaagcaacactatatcattcatccatgcttaattcaagttcccttatctttttccttattgagtcagcaaaggaaaaccataaagagattctatctaatttgccaagtctgggcatttaaaacttcccctctggatagctattcatggatgtctattaatttagtgatcatagagctttactaaatatttctttcttttaaaaatattaggagaatttgaagaatacaggtaacagtagaaacagcctgatgataagaagaacaagtaatgttatggaccttgtgctgtgttactacgataaactcattgttggcttaaagacttttgcccaaaataatgcatgaacagattagcttgctaagtggataacaataaagtcatgctccttttaaatcattagaatctttcccattataagcccctactttgactttcctgggttagcagcatttctctctcccttccccttcctctgtgtggaactgtatgtgtatgtgtatgtgtatgttgaactgcatgttcctcttctcaagtcaccttacatacctctctttttcactttcttgtgtcctaacccttattttgtctggactgatgaaactttctgcatttgtttccatttccatgatatttaatattattcattctctgatcagtgtccattgagagggcttgtaaacaaaaaagctaaactacactgttaagtcccttcctgtttgtgtacctaacaagatatgtggtacacttatcaatagagtattgagatgaatataattgaatgctagtttattttcatttttggtactctagttaagtaactcaacaaatatttctatcacgatgagacagtcagcagtaatatttttgtatcaacacatcagcacattgcatgatctggctgctgacagatacagctaactattgggtgtgtacttagcatataacttttaaaacacatatgcaaagtgtatttgtttcttaggaaagtagtggggaagaactttgcatacatgcctccagctacagttcatccagagggtaacattcaaccaggcctctgacagttcttccagatccagagagcaactttcgactagaccctatggtaccagtacctggaagcaccatgggaaaagccaccagcactgtctgcctcagagaaaacaaaactaatacattttaattaggattcagtcgaggaatgcaactgtgaaatgatgtctactaccaactaactctctataaaccaagatctattactgatcttcattaagtcaagaaaaaacaggcaagggttctacctactgcaaaaagaattgctcatcctatctttatggctaggcaaaagtcttacataaattatgagacagttataaaaaattcagttctatttgcaaacaaaagatactgctctgagaacactaagatatgggttttagaccattggatattgcattcagagaggaccatattttataaatactgcttggcttcttagtaataataaataaggattataaatatgcacgaaatacctggccacacaactacctttatgggtcctatattttgttcttgatggtttataatttctcaccatactctaactctttacttcgtttggagctgcatttttatgactcatgacaatgactcaaactcataatatttggtgtattttattctgtacctacacaaaccattctgtaattaaaggccacttattatatgtagtcatttcaaaatctcactaaaactgtaccagagagtagcgtaaagaacacttggaacacacattttatttccggaattgtgcataacctggtggttatggaaagaaaaacaaatcaagggtatattacctattgtgttaactctagtaactccatataaataaaagcagtccaactgtatgaaggagagattagatcccaacccacactggatattcaagatagatttattgaaaaaaaaatgcttccatttacagggtattatggaaatttcataagaccccagtaatgagccttaaaaac

SEQ ID NO: 13 - DNA, 25525 bp, Mus musculus
attttcctaggctgtctattataggcaagaaaactttaaactgaacccacagaacattttttaaaatgttatgctctagttgtaacagatatgcttactttcagtctgtatgacatggataccatggtcatcctgttagcttaatgtgttcataagaaggtgcatcacaccaaacgtagctattttaacatgtataaagtatccatattctagtcaatcctatgtatatacattatttagtaggtaatagtctgccaaatagtctatgccatgagaagataagttcacatctatactggccatgggttagaatctgtactcaaaagataatgtagagaaaaagctgacagagggccagagattcaattacttgtaataatgccaatttggggacactttaaacaagataatgcttctgtaagcatagaagaaagtaaaacaaaggtgttctcatatgtcagaaatggctgttagacacataacaaatcatcataaaagccagggcaagccaaaggttatagagaagatcctctgggtaaatttggaacacaaagatttgagacaccgaagccacattgctaaatgaaaaataggcactatcacttgggccccacaagaaaaacaaacaaatgtaaaaaataaaacagaactaaactaaataaaatgaaagtcttggaagagaaactcttaggggggttaggagcacaagaagccatagaggaggtaaaaggaagaaatgcaggcagaactgaccagaggcaggttggaggacaactttcctataaataggaaagccaaactgtgaccaaatctggagccttcctcccttggtcaacagttctctcaccttacagttatatcacttttgtgattctgtttatttgaataaaaggtggataatgataactgtcttgccagatgcagattaaataggatggtgtaaaactatccttcatgcacatggatgcagttaaacacatacaaatgtaggcttttaatttcaggtccaatacgtaggagatagctaataattccaagaagagattagaaatcaagcacactagccatcctttagttataataaacactatccacaaatgtttctcaaggatattgatgaatcaactcactcattcctcagttgaatcacaagcctagtttaaagttatttcagttccacctcacagatgagaaatatctatatgggattaagcaaggaaaaagatcaaagcaatattactaacggagtaaggttcacaaaggtttggtcagagaactctctagaatcacaaaacaagaacttgttatatccatcttctctacactgtcacttcctgttgttgtattttggaattgagtcttcggacccattgtcaatcctttgctactgtattcatcctccagatgcaactatgtataagtcttgtctacttggggcaatatatatctaggagatagagttataaagcacatatcccaagaaaaggagaaacagatgtaatattggcatttctgtgtccacagcacaaattccttttttcatgagtttgttcttattattatagccattctttccctaaacggtaaagttattttagactggattttttttcctatagtgggctaaactcctctttctgtgcctttgttggaaaaagtgataagagaaatgggcgttatactgggagtttacatgtggagagtagaaaatgaaaagagaataagcaaaacaaagagagtttttgttgaaggaggagccaaaaaagaaagaatacctccatatctaatgtgcattatcataaacacagtgtacagtttttgctgaccctcccatgacctggctccacccatgaggaccacgggtcaggctgaccaatagcttcaaagaataatgcagaacaaagggtcagaacattgtctgtgaagcataaaaggccaccacttctagcagcagtacatacttgcttctgacactcctgtgatcaccagcaacctcccagacttgccatcatggtgaactttactgctgaggaaaagaccctcatcaatggcctgtggagtaaggtcaatgttgaagaggttggtggtgaagccttgggaaggtaagaattgtttttagggtacaaagagctagggaaatcaagaattctgaggctcccttatatttctacttgtctttctccacttcacaggcttcttgttgtgtacccatggacccatagattttttgacagctttgggaacttgtcctctgcttctgccataatgggcaacccaagggtcaaagcccatggcaagaaggtgctgactgcttttggagagtccattaagaatctagacaacctcaagtctgccttggccaagctcagtgaactgcactgtgacaagctacatgtggatcctgagaacttcaaagtgagtctagggcaatgccacaaatttattttggatttgtctcggggacaaaatgagaagccaagaatatgaataagggggtgcttacttagctgtcaaagttaattaattggtcccagtagggtgacagtgaatggctgtaagaaacctaaattagtttacaaacatttagaaaattttgtcgtgataaaattttcttggatttatcatggagagtaatatgaaaagtagtagatctatgcaagaagaaatggaatagggagtggaaaaatcttaactttttgtgggtcctattgattgatgttgaagaaaagtcttgcaagacaaccttatggtgaattttctcaataaacataaaattgtattaaatttccaggtgaatatcttgacaaatggaggcttgttcttacattgggggtagttttaaaactccaccaacagcagtaggaaaacacaaattctgaatttacagatactagacaactgtagaatgagaataacgacaggcaaataaatatgctgagaatagaaggtatgagaatccaggcagaacagtggtgagtgggaaaaaaagaggaacaatagaaaaatggaatctctgctcatcagagatgattgaggaagctttgatgctgaatgtgttaaagagtatgggttcaaaatatttctttgtttttttaatgcttattcgtttcaaatcttcatttaacacaccgatttgtttcttttgtctttccatcaacagctcttgggtaatgtgctggtgattgttttggctagtcacttcggcaatgaattcacagctgagatgcaggctgcctggcagaagctggtggctggggtggccactgcgctgtcccacaagtaccactgagccctctctctagctgtccagcaatcctgtgtgtccgctatgcctcctttctgcacatgaatactggactgttccttgaaagcacatcatgtttaataaagatcatccttcctggtaatcaaaaattcagttttgtcttgtctgctttctacttttatgctaaagacacatatttgatgtgtttttggaaagggggaagcacaggaagactcaggcatttatctgaaacctgcagggactcaagagagaaacgtagaagccatggaaggcttctacaggcccagtgagagtctaaagctgagaaagaattctcagagagaagaaagaaatttagtggagaaggcattgtgtatggaacatatgaacatttactgtagagggtgaagaaaagggtgacaagtgataccttgcagcaggttgtgacatcccattaccattaggaaaaagcttttacaagatccaagagctaatttagaattaactttctttaaaaaagcatttgttgggtaaccaattggtgtgctctgccccggggaagactcttgatccagctctcagcaacccttagttgactgtaattctttgtgtatggttgaggtctcatgggctttatttaccccacccatattagcaaatgtgtatcacagcaagcttcatggtcttttggctcttacaatcttttgcccttcttctgaagtgttccctgatccttaggtgtgtagatgtatccactgaggttaggctccacaactctgaagtttgaatggttgtggatttctgtactggtctttgtctattgcaaagagtgttctacatgagaggagaagactacaacttatacatatacacacacacacacacacatacatacaattacaatggcaaaatgacacgattttgaaacatggggagggggcaacattggagatgtaaagtgaattaattagtggggaaaaaagaaaataaaaaagtaaaaaaaaaatcataataaaagtaaattattttttaaaataattaaaattaaaatttgcaactgttcagaaaagtttttcagacagacatttggtgtctcggtatgtaagtcagttgatgaaatgaatctctggggtatatgaatcctgagactggagcactaccaaaaagacacaaagtagcagacttatagagttggttatagaatcctcctcacttttgtgttttattttagaaggtagcagatacatgtaagtagactagcccttgaaattgacattttgttctagggaaggagaaataccctatttatgtggattctaatgactaacccttcagcaaaaatacgagagaaaacttgacagatgtttctcattggtttgatgaacttcctaaaaaatattacaatcccaatgagtaatatcataagtagtccctgcttccttcattataggaaactctagtaaatacatggtaatcctgtatttgtagaagccaggccattgttgaatgagaaaaggggcaagaaacaaaagtggcagactgaggaaaagtaaggaacaagtagagaaggaccgaatggggtcgaggagggcccttgagcaatgagattgaaccagcatcctcattagagtggacagactgctggggagtcctcaaggagactaacttacaaatgctgtttgtcctgtaaattcttttctttatttccttttctcatttttgtatatctttttgtgtttccttccatagctcctgggtaacatgctggtgattgttctttcttcttactttggcaaggaattcacagctgaggtgcaggctgcctggcagaagttggtggttggggtggccactgctctgtcccacaagtaccactgagccctttccctgatgtccagcattctgtacacccctcagctctgccatacccatggccactgtgctggtctctgaaagcagggcttctgcttaataaagtccattcttttcagtaacccatgagtcatattttgttgtgtctgtttcttacttttgtgtttaaagaaagaaggctgatgggcagatggtaagggagcgagacagaaggacgcttgagtttcttttagaactttgctggaattcaggagaggaaagtagatgttacagaatttttctagagccccaggaaagatgagaagttggggataattctcatgtaggaaagcaaagggttaatgccgtggagaaaaaagttctgtggtagtcactaaaacttagtgtagagggtgaagaaatgcatgacaaatgatcacctacagtctgtgttatgtgccatttaattaagttaaactttagacagatctaatgctcaacctgagataatcagtttaattattttaaaaaataatttacttttattatgattttttttacttttttattttcttttttccccactaattaattcactttacatctccaatgttgccccctccccatcccccctcacacaatttcttctcacatcctgcctcttctcctctgaaagggttgatcccctcctagggtatccccgcccacacacacacaaccctggcatatcaactctcttcctgactaggcacatcttttcccactgaggtcagacaaggccatccacttaggggaattgattctacagacagtgaacagctttagagacagacaggcttatattttccagttgttgggggaaccacaagaagattgagctacacatctgctacatatgtgctgggacctaggttcagcgtgtataagctctttgattggtggtacagtctctgagaccccctaacagtccaggttagttactctgttggtctttctgtggagttcctattcccttagagtccctctatcttacataagagtcccaagctgcattcaatgttggcattcgtttccaggaggggttcaggtttaagtgtgggaggagacaggagagggggccaaagggcctggagaatgaatggaaatctgcagttggcaatgttgtaggtatgggggaacattacaagaatgtgccataaacctgagatgggggaggctcctgagggttcatgggggaggtaaccttatctgagactcatagcagtgggggtatggaatctgaaaagtccacctacagtagccagactggaagtccagtggaggaataaggacactaacccatccacaaaacatttgaccccaatttgttctgtctacaagaaatgtagaaacagagagggaacaggaattgagggaatggccaaccaataacaggcccaactgtagaaccatcccatggacaagcactactccttgaccccatactcacttatgcttgcagacaggagcctagcatcaccatcttcctagaggttccacacagcagctgacttaaaaaaaaaagatttatttctcttaatcaagtatctctgcatttatctgtgtttgggtttgtgcacgtgagtataggagactataggcatcaagttccactagagctggagttacagatggttgcgagctgtatatgctgagaattcaggtgctctgaggaaagtatttgctctcaaacacggagtcatcatctctcccacgctaaatgaacattctccaacagatactatatcagatgtcctctggaactgatgaaagaaaagggacaagttgatagaaagcattaaatatataagaaaaagtttcaatgaaaccaccacttcagacttgttttttgaaggcattccttgtctcaaggaggaatgaaagctaagagatgcgaccactgtgcttttctgtgctactgtaataagcaatatgattatgatagggaaagaatataaatggaatcttctccagacaggtgggcatgataatttcatacacaggacatctacaaaaatgccaaaaagttctgtcatttaaggtcactgaactagatcttgatgatttgtataaaactagaagatgctgaagagataaaatactggcaaaagtagacaatagggatcttaattataaaaatctcaatattaatactttattaagcattaaacaataacacttacctggtgaaatatgcttatcactccactacttgaaaggctaagcaaagtgtcacagtttcaagagttacctgagcaacagattgagttcaaggacaaccaaagaactcaatgagttgctacctcagaatgaataataaaaacctggtctgagggtgctgctcagagcagagcactgtcctaacatgtggactgctagggaatcaagatccactagcactaaacaaaagacaccaactgaattgattagtaaagaataagcagtctcaggatttctgactcaagaaatggtattactaagaaaaatattcttaaggatccaatttaacttaaatgcttaggaaccattacagagatataaaagtttaaaatgaagaggtgaagcaaggcatgcaacctgaggtaatgttcaaaggtgggatgggggagacagtgtcagattaactctaatatatgagaagaaaacagaagatagtagaagatgaaatcacaaatactgagtggacataactacataaagtgtacattgacttggaaaactcatgtggataaaacacacttgagagaatttaaaggtgctcaaagaaattcaagccctagtcaatctcttgtcaaggctggtgatctttaagtggtagaggtaagataaccacattttagctactaaactatattccctcatcctgattccatagattggttagagtatgactggtggattgtatttcaagttgtctttgtccactttaaatatgaaagaacaatgattcttgtagttttaggctatcaacaacattggcctttttggtctacagcatttcaatatggcaattaacaggaaaacaaaccaaaccaaacaaacaatagcaacaaaaatgcaggcgttgtatatgacactcgttttctctggacctgtcaagagatgagacaatgcccattttttataaatttacttttctccttatgccatcatgaatattttggctctagaaatcagcggataaaagatggcaattatgcagtggtgggaggaaagtatatttgccaaatgtttcagggctatatatacctataaccactccaatggaaaaaaagagataactgaaaaatagttcttcatatgtgcacacacacattcacatatacaggtaggatgataaaagacttttgcttgttttatttctcaagacaaggtcctcttctgtagcttcgatggcttagaacttaatatgtagactgtgtgctagcctcaagctcacagagatgtgtctgcctccttcttctgagtgctgggattaaaggcatgtgctattctgtgcagcctatgatagtcaatatacatttgcaataaaaattatttgagagaagtactatgaccctagaatagtagtgcataagaaatgagtagtattcaaaggttatgtcattatagtttctcattcctattaaggaagatggattcctctgttagattatgagcactgcagcaacacacccaccatgttccactttattatttttatatttagtgatcatggatattatcagcttcactgtcacagaaatatttattttctcttccttcagaacactgaatttgctattacaacattttccagtatctttctgtgacatgttacttctagacattctggacacaacaaacttaactcttcattatgtagagaaactgaattccataccaccatgtcctgtccttgttaatcccaattgttaattttcttcctagtaataacatattaaaatcttttttgtttgatatacttactcatttctgtatcttctatctcctagtgaatgaggctagagaaaagttctgtcttgtctctcattcattataaatcccaggacttgtgaaggataattctacagagaggcagcaggaatgggtgggtgggtgaatgaacaccctcatagcagggggaggggagataggataggagggcttggggggatgggaaaggggataacaattgaaatgtaaatttaaaaaatcaataaaagagaaacaaaagatcccaggactaataataataattatcacatagttatgagacaaataatgattgagtgaacatttgagattacatgaattagctgtcataaagaaacggtttcaaaatcctggactaacatgacatggggattatggagggtctattaatagacatgaactaattaatacaactttgtaggaaattcccccaagactctgctgaagagcaacttagggttactggttaagatatttggaagcttaaactcaggactaccaactatcctccaagattaaatcatggagatagaagctaaaggaatatatatgtacatatttgccatctcacgaatgacttccttttaaaagatcatagctctagaaggtaccagagatcggggagctgagaaactttcaggattcaaagggagggacctaagatgaaatgccctataatgagaagagggaacttgtagagtccacctccagtggaaagacagggcatcaagtgtagggatggtgttgccatcccacagtcataaactctgacccaatactgaaggataattctacagagaggcagcaggaatgggtgggtgggacgaatggagaagagcctgaggaaaaaaaggttcagtgactggccctatttagaatccagttcatggggaggctccaaggcatgacactattactgatattatggtgtgcttacagacaaagtctagcatggctgtccaacatgaagctgagtcagatgcagatacatacacctaaccaatggacagaagtcatggacccctgtggatgaactagggaaaagctggaagaagctgatgaggagggcaaccctatatgaagtttcaactgacctagactcctgagatctctcacacactgagccaccaaccaggcagcatacaccagctgatatgaggtcactgacacagatacagcagaggactgccttgtctggcctcagtgagagaagatgcacctaacctttgagagacttgaggtcccagggagtggggaggtctggtgtagtgggagtggggaggcatcttcttggagataggggaggaggtatgggatgaagaacaatcagaaggcagacggggagggagataacaattagactgtaaaaaaaaaagatttatcagtgaaaagaaagaaacagagggggggagggagagggggagggggaaggggaggggagggggagggggagaaagagggagagggagaaggagaaggagaaggagaaggagaaggagaaggagaaggagaaggagaaggagaaggagaagaagaagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaggaagaagaggagaacatagctggttcttgttaacattgcatgttctttacagccatgcaaataaaaatctctattgaccactacgttaaaatagctacaaaaccttaaaagctgtcagtagaaactcactgctagggatgaacttcataatgtataatccagtcctagctgtgatagtgcatgtgttactgcatggaaataccctgtctcttcacagttaggttacaaacacacaaaaagtgaaaacagagctgagttgaagaaacctgaaagcttgatcatttagtgttctcagtatttaaccagtaatgatcatagagaaggctaaaccctcacccttttcaccaggcagctacacttatcctgggtgggtgggtgggggctgccaattgtatggtgtcaacactgtgcattcaatgggtggaaaatgctgtcatgtacacagacttctctactttagtgtatgatggaatgtggagacatgttgtacttctacacagtaatacatatatatatatatatgtgtgtgtgtgtgtgtgttataaatatgtgtgtgtgtgtgtgtgtgtatatatatatatttttacttagaaactgaaatgtattaggaatggctttcctggggctgtgggaaataagaagatcatgtcctaagcctactgaaaatgcattcaatggttttgcacaccacatctttcttatacgtggcttgtgagtaagactcatatttctatcacttaggttcgtaaccccattcctaaaaatagcctctggctcactgaggcgttcccatgtttgcctatgcttcaacttaaatgtattaatccctctaagtctgaagtgaaaaagggaagaatgtgaaagacacccttgcaaatctcctgttgggggaaggagctaaagagaaggaaagaaggaaagaaagacggtgaactctgggaaagctgcagcaggaggctctgtctctccgaggcagggggcctactggacactatcttagtgcattgctatctagaacttaccccactggaccccacccctgtcttgcccagactctcttgaccaatagcctcagagtcctggggaggggtaaggggagcaaggtccagggtgaagaataaaaggacaggtcttcagcctcttgaatacacttgcttttgcacacttgagatcatctccaagcttctatacctcacaccatggttcacttcacagctgaggagaaggcagctatcacaagcatctgggataaagtggacttggaaaaagttggaggagaaactctgggaaggtaaggaatggagggaaattgtccttgtgcatggcagaaatttccagggtttctatagggttttgtggcacactaacttttaactgctaatgccctatgtcttaggctcctgattgtttacccatggactcagagattctttgacaagtttggaaacctctcttctgccctggccatcatgggaaacccccggattagagcccatggcaagaaagtgctgacatccttgggcttgggggttaagaacatggacaacctcaaggagacctttgctcatctcagtgagctgcactgtgacaagcttcatgtggatcctgagaacttcaaggtcagttctgagcatgctcatgtgttcattatggattttactagggacaatacttggagttgagactgtgcttggcaatgccttgacagaggttagagtccatgggtccagaattcttgtcagtaaccgttgtagaaatcttaatatttagctgtgcatatgttctgggcaacaatgatttgggtgcagatttgagtgagctcccagcatttctggggccttgggtttgattctgagcattggaaactaagcattcaaatattggaattttttaaaaaaggagtatgtttttataaattaatacatctatgcaagaagaaactgaatttaagttaatatcttatcatttgaaaggaaaaataccttaattaattgtgtcaatcttaatgtccaatcctttatggaagactcgaggaggaaatcaaaatatagggtttttttttcttattattttgacaactttctaaatgttttactttcccactgagcattggcacagtttgagccttctctttggttgaacactcaaatctactaagaatcttgtatcgcagtcatgtgttgatttagatttgaccattgatgaatgagacagggagcaaaaaatgggaggagataaaaagggcagaatgaggaaaggtacagatatagccagttgagtggtgtacaagaggagtcatgtaattcagttgtcaaatgcataacaggagaagtgataggtagtgagggactggaatcctcaaggaacgtaacttttacacgtcacagatttgaaactactgatcattcctatgtgcctttttgttacagctcctgggcaacatgttggtgattgtcctttctactcattttgccaaggaattcaccccagaggtgcaggctgcctggcagaagctggtgattggagtggccaatgctctgtcccacaagtaccattaaactccattccagtacactggcaatcccatgtgtctatgatgccctctttgagtccatggggactgcattgagagcacaaattttgtttaataaaattgattcttaataacattgactttttgttttttttttgtttgtttttacttttatgttgaagaaagatctcaatgggcttgttggtgggaaaagacagaagaagaaaccagatagagtgaagtattagggaaagagctaagttaaagatgagaaagttttctccaggaagagatgaaagggtctgttcagtataagatagggtacaaaatatttactgtgcaaggtaaaaagtagggttgcaggtgccaggaggtaaagaagactggtgagatgtgctatttcttttttaagtttcactttttgcatatgagtgagtgtttttcctgcataaacatgtgtgtgtcctacctgtgtgtggtgctcctgcaagccacaatatagaattacatcctctggaacttgagttacagccaattgtgaactgtcaagtaggtactgggagctgaagtctggtcttttgaaagagctatttaccactgagctccctctctagcccaagatctgctagagatttttaagagaatactttaaaatatgaacaaaaagtattgtttttgattagttatatttctgaaagagctatcttacatcttgtgagactgagacattaaagaaaaggggggaattgagtgaaagttgggaacattcctgaaaaaaaattacaggagctactgtacctatactttctttaggtatttgtaaaggttattccactggcacagtgagaaataaaggctatagcatctagtggtccagatcttgtaatggggtgtaacatgggcttacatgaaattagcttacatctagctacttcagaagatacacatttctagagacaaagaggaactagagtcaacttgataagaatttcatcccacattccactccatcaaactgaatcatagaaaaggatgagaccgcgtgtagctggtggctgtatgaacaaggaataggtgaacccgatgggagataaacagagggattaatgtttctgcatcaaaacacagaatttaggagagccaacactacagccagctagtgtaaactggagagtgtggatatatctttcattcacaagccaaataatttcttcatatcttaaggtaacttgctcatagggtagggagggcaggagtctgggctgggcataaagggaagagcagggcccgctgtgcctgcacttacttctggcacagatgtgtttactagcaacctcagctgaaacactatggtggagctcactgcagaggagaaggcagccatcactgccacgtggactaaggtgaaggcagaagaacttggtgttgagtccctggaaaggtcagtatccgacagcctaagggagcaagtggaaggaggtatgtggaggcactgaatttctctgtcctcatgcttcacttgctagaatactgacggtttatccacacaccaagagatactttgaccactttggagacttctccttctgtgctgccactgaagataaccacaagctgaaggctcttggtaagaagatgatagaatcctttagtgaggacctgcaatccctggacaacctgcactacacctttgccagcctgagtgagctgcaccatgacaagcttcatatggatcctgagaacttcaaggtgagttggctagatgtgctgccttctgctcacgctcttgatttctacttactgctgcatcccccaccttctctttcatttgcctacacttaatcgtctaatgattttcaacttttgttcaatatccttcttaatttacccctttcacaatcttcaattaaagaaatgtatttattttatatcctgtcttttgtgctccacccacagctctacctacatttatcctcaagtcccttgcttagaccacaagtcaaatgacacattctgtttttcattttctaattctagatttggggaaacattcttccatctccccctaatataggaggctttatgagtcttctcaaggaagagaaacagaacatctggttttaaagacatgagaaaaagaataatcagaattccatgaaattagtaaaggttaagatgaggaaaaaatatgtggatggaaggaaggtctgaacatcttgttagagttggaacaatagtggtaaagagagagcctatcatcagattaatcaactgattattaagcatacacttaggatataagtatatgcatagataaaatatatgtacatatacttatatacacaaacacacatgtatatttacttttttattttggaagaaattatctaggaatcaaactgggatagaatgttggcagaaactcatggtgtttggtatggctcttcagaagccaagattaatttccctatcatatgcatgtctgtcttcctctttcccaaagctcctgggcagcatgatagtgattgtgatgtctccacactttggcaacagctttacttcagcactgcaagctgcttttgagaaggtggtggctgctgttgcagatgctatggcttacaagtattactgagaccccttctttcgcatggtcattggaagatccttctctagaatcctgtgttttgaagtttgtattttttgggggggggtgtccatcctcatggcatagaatctgcttaataaataatttcatgacttatttcattcatttttcccacttagggatgtgcaacacaatagaagatctacaaggaaaaagctgctctgtatttatgcaaatagttggaagaaaactctatagagatactaaaggaaggcaaaagataggatttgaaaattgaaactgaagaagaacgaagaccaaagtgtggacactttgccccttcttagaattggaaacaatcatccatggaaggagttacagagacaaagtttggagctgagacaaaaggatggaccatctagagactgccatatccagggatccatcccataattagcctccaaatgatgacaccattgcatacactagcaagcgtttgttgcaaggaccgtgatatagctgtctcttgtgagactaggccggggcctagcaaacacataagtggatgctcacagtcagctattggatggatcacagggcccccaatggaggagctagagaaagtatccaaggagctaaagagatctgcaaccctgtaggtgcaacattatgaactaaccagtaccccggagctcttgtctctagctgcacatgtatcaaaagatagcctagtcggccatcactggaaagagaggcccattggacttgcaaactttatattccccagtacagaggaacactagggccaaaaaatgggaatgggtggataggggagtgtgtgtgtgtgtgtgggggagggtgtgggggacttttgggatagcattggaaatgtaattgaagaaaatacataataaaaaatattaaaaaataaccataggatttgtcataagtgtttcatatagagagggtcttacccttttagaagatttatgagaaacttccaactgggtaaaaggctcaaggctggctactgttatgatccaacaattaccatgcatagatagcaccaatctaatgcataatgactatcgaaagcattgccatgattcttcctttatctgtagactttagcttatactataacataacaagccatatatatataccttctttgtcttactagctcccaaataccaatttaaaatttagctcttgaattatgttggcccctcattcaatgaactaatacttcctaaagaaatcattgtgaacattctcactctaccaacttttcaaattgctcttttaatcacacatacactcccacacatgcactcttctatacatgaacacatggtcatgctttacaaatttctgctttgtgggagagatttatactgcaatctttcttgctattaaattgtattttgcaattaaattactatataggtagtaagctgacattaattcaatgaaataatcatggacaatatatctgaaacacctatggctggagctaatcagaataattataggatattataaagctctactcataaatgctacaaactacaggaaggaaaaaggaagaaaccacagaattctgatcatgtgtagaaaaatttctttctttgaatgctctttctgctatatgtgaaattagcaagatttttaaaaatttctgactcacatgtgttccttaaaattatgttctgattggctgcttttagatgtacttgttattcagaacctggctcctctttctttgtgaagtcacccagtctcctaaagaaaacacacacacacacacacacacacacacacacacacacacacacacacacacacacacacacacaccctcatatatggattcatatatatggtatatatatgtgaaaatactgttgtagtaaatctgcctatactgcaggatatactgaccacattatactgcactgttggtagcaagcctgagtccagaggctgtttcgtgttcaatctgtccttctcagtgtatagcttataacagacaatgagaatgctttgtagatagaaagtatcttctagatctcccagatgcagggcaactgcagagccatttcacatagcccatatttctgaacagataaaaatcacaagagtgagatgttaaagaaggatggaatttagggggatgtttttcttttaggaatatatagtgtatagaggtcatgtcatcacagctccttattcctaccctggaagagaagttttaccatgtttatgggcaacaacataacctgctaggttccactttattatttccatatttccctcataggaccattatttattagtttctatagtatataaatttgttgtttttttcctcctgtttcagaatactgacttggttattttaacatataaaatactttttccacaatatttttctgtgacaggtcatttggatatagaatagtaacttcatccttagagagaatgatcatgatatagccatgtcctactcttatgaatccctactgttaattttcttcttagaaagtaatattaaaaatatttgattgatttactttttttcattttccatatttgttatctcctagtttatgagcctagaagaaaaatttaattttgtttttcatttcataaatccctagggctaaaccattatgatacagttactcaacaaatagttgttcaatgaatgtttgttacaatatgaaactgtaatctttattacagtaatttattactgtaatatatacaattttgttacaatatgaaactgtagtctttaatggctgagccaggggggaagaaactgggtgagagagggagtaaggaaggaataggaatggggatcaggtctggggaataagagtgaggtggagtgaggtggggagggctgggagagggaacagaaatcagtggggtcatctttggaactagccagagacctaggaaaggggagggttccagaagtctagggggttggttaccctagctgagactcctagcaactgaggatatggagactgaagtgactgcctcctgtaaccaggcatgacttccagtggaggaggcaggcatcaacctttccacaaaacctttaccccaaatttgtcctttctacaagatgtgcagggataaatatggagcaaagactgagggaatggccaaccaatgactggcccaatttcagacccatcctgtaggagagagtcaacccctgacactattgatgatattctgctatgcttacagacaggaacctagtataactgtcttcagagagccttcatccaacagttgatggaaatagatacagatatccacagtcaaatatcaggcagagctcaggaagtggtgcagaagagtgagggagaggattgagagagccaaaggggtgaggacaccacaagaagacctactgagtcaacaaaactggggctatgagggttcacagagactgacccaccaactaaaaagcatgcatggattggacctaggctccctatacatttgcagcagatgtgcagtttggtctccatgtaggtcccctaacacttgtaaaagaagctgtttctgactctgttgcctgcctttgaatccctttcctctagctggactacctggaatgggccccagtgggaaagcatggatttagtactggtgcaatctgctgtcccagggtgtgtggcacctaagtgggagttttcccttctctgaggagaatggaagggggtaatgggaggaaggatttgagagggtgggactgggaggagaggagggagcagggaccatgatctggatgcgaagtgaataaataaattttaaaaagagagaaaaccccagaaactgcttgtaggtgagcattcaggtatgagcaatggcatgtggaaaatggatggtacatttatagacatgtagcaattaatttatctttggaagaaatagccccaaaagcctaaggagagagaaattattaaaaataactcctagattgctagtaaggtgatgactttaattttcctgcacctaagaccatatatatcctagatgtccaacgagacagaaaaggcttactatttaagatttttggaagtttagatactggacatcaaggtatcctaccaggtcagatctccaactttgaaaccaattggatatttgactatgctgaaagagttgtatgcagtactattggctcacaaatattctttattgaaggagaatctagatggcattttctcaatctctacattctgtccctctacaccaattaaaaaaatcctctctatatccatttctatataaaagatataaaaatcattgcagctataaataaaatattactaagtagatataaaaagctctcctatttggccatatggctattcccatttgtgtgcatatatgagctttgctagagatgaaggcaatcaaaatgattcatcttcatttttttaatttcatgccatccctagtttgtacactaagatagttatattaatttacttgagtatacatatttagaaacagctacattccctttattacttgagagagtcatacatccatagcaatggtttgatcaaatccacccttcagtctttcccattcaagtcttcccttattcacctgccccctttccttcccaacttcatatggcttatatttaagcccagtcatttgccttgtcattcatggcaaataccattttgctgtagatgtccactacttctggctcttaaaatatttcacacttttctcttccaaaattatccttgagccttggaagaaggaggtgtgatataggtattccattaagagctgccacaatctttctctgcggattgaccagttttgtttctcaatttattggtatctgtacaaaggaaggagcttctctaatgagagttgaaagatgttttattctatgtatataggggtaagtacttaggcagaaatttacttttatgcttatttaagagaataattatattagtgtttcctttatgacttaggcagcaatgttttgggtccagataactgtaccaggcatgagttctatcttgtgaagcagaccttaaattccatcagaaactggttagttgctctcataacagtcacaccacaattacctatgtgggtacacaaagacaatgacaatatatgctaacgtagatagggaaaagcccattgggcctcagcccctccaacaaagaacaacgggcaactaaagagtgtgagagctagagaaatagtcttccccagagaagagcacaccaagccttcagacttgaaaacatacatgcaagtaacattacatggaagtcaggtagtccgggatgggcattaaaggtagagcagtgcctgctgtgcctgcatctgcttctgacacaggttgttcactagcagcagtcctacaccagggtgtactgactgacaaagagaagttggccatcagtggcctgtgggacatggtagacatgggaaacattgatggcgagtcactggagaagtcgtaatgggctgcataagcaggacacatggaagcttggtaggtgaagagagagcagaatgtctggcaggaactgattttctctacccacctgaaacacctggccatcctcaagggcatcttttctggcatgaatgaagctgcactgtgacaagctgcatgtagatcctgagaacttcagggtgagtgggccagatgctctggcttcggcttctgctcgttttgtcacttctttttccatttgcctttttccccacagtttcctctactgttctgtatttcttcacttaacactcttctttggctaactttccttcacaagtcaacttcctcccttccccccccataatcttctttaacaaatcttttcctccttcttcctctctctctcccccaattcccttccttcattcatcttcaaatccccttggtaggatcacctcctgagttatacatactatctctcatctactatatctacatctggaaaacatccttcttactgctaccattgcttgagcttttgagagtctccttaatgaagaggcacgtgtggttctagagtctttgaatcattctttaaataataagaatttcatgaatttaggcaaagatttagtgcaaagataaggaaagaatagttaatgtctaaggatggaagacctgaaattcatattagagatggggtaacagtagatggtaaaaaggagcccaccatcgaactaatcaattaagtagtaaatataaatattatataaaaaatacatttatataaagacacacattttagaagaaatatcctggaaattcatagtgttggtgcaattccttaaaagactagcttgatttctgatacccaggggtaaatgtgtgtgctcttctccacagttcttgggaaacataatagcatttgtgctgttcctccattttggcaaggaattcaccccagcagtgcaggttgcttttcaggtgttggtggcttctgtaaccatggatctagctcacaagtaccacagaggccttggactatttcctcaagattactggagcataatcttctatattcagggagatatgtccacctttgcaacttttccccaagaaaaagttagttaaatttcatttcctttatgttgttgttttgttttgttttctttccccctagggatgagaaaagtctcagagagcctctaagtaggaagcttttatataatatacaaatcttaaaggaaataattaaacctcatcactactagggttttagtgaaggctgggtattaaaattgcaccagtaaatgtaattcataaaattatatattatgtgtaacaataaatatgcatatgtaattcttacctgaactggagaaagctgtaaaagaacttagtattttctacatgaccaagaaaaatctaagttttgattgtgtgcatccactgaggagttgggacaggtaaaatgagaagagaaatcttctctcaatggaggaggggctacttggagaagaggcattaaaaattgtgtaaatctcctaatttgcttggtaactgaatgagagaaaggcagtttttatttatatatttatttttatttcattttaattcagattgtggctcctagaggtttgcctgtgctccagtggttgatcttatatctatgcttatatgaggagtactagctgaactttatgggtcaaaaaaagaggctataaagtaaggatcaggtaggagtttctgggaaaacttgggaagtgggttgagagagtgaatatgatcaaaatacattgtatacaggcatgtgattataaagaatgaaaaaatatatcttaaaatttgaaaaacatggctggattataatgtttgagtattcggaagggacatcatgtgctaatactattgaatatttgttgcttgtgatgaccaaggggaagaaagatgtttctgaatagtgggacacatagataaagtagaaaaacactataatagagtagtatcacactgttctcagtttaggcaggggatgaagatcccaaaaccttgatgataaataaaagcgagtgaagacttagcagggagcttgagagtactgggatgccacactgcatcagaaatatctcttctctttacattcaagtcttcaacatcaagaaaccaagttacagaagttcttaacctgagaactgaaaagtatattacttgggggaaaaagccagaaagcaaaaaggttttagaagagttacagagatgtaaaagtaaaattttacaaagaagacagattgaatgaagaagcatgcagggaacttgagagtggggtatcttagcatttctattatgtggtaaaacatcagggtcaaaaccattagggaggaaaacatttactcatcacagtcctctcaagtcttactccatggagtgtgtgtgggtgggggggcggggaagagggatgtcaggacaagacttcaggtcatgaacctggaggcaggaactaaagcagaggcacggaggaacactgctcactggattgttcctcatggctttctcggtctgctttcttaacgcaccatgaagcacctgatgaggggtggcaccatcctctatgggctgctcaccagcatcagctattaatcaagaaaataccctacaggtttgcctacaagtaatctgatggaggtttcttttcctttcctttcctttcctttcctttcctttcctttcctttcctttcctttcctttcctttcctttcctttcctttcctttcctttcctttcctttcctttccttcctttcctttcctttcctttcctttcctttcctttcctttcctttcctttcctttcctttcctttcctttcctttcctttcctttcctttcctttcctttccttcccttcccttcctttccttttcctttccttttctcctcttttcttttttgttttattaactctttctcaacagattttattggtctaagagcagagtacacagacattaccattcttatcacacatacccataaagagccatatattgtgttcatgtacccaaattctgaagagtcacactgtgttcacatgcacaaatgaagatctacatattgttcttctttgaatttattccagtgatgttccagcctcaaatttggcaagtgtccctaagacctctcataacaaccgaatgttcataatacccccttccaccaactcacaattttatgtcacacacaggacatactgaaaatttccatctttcacatcacattatcacaactgttaggaaagtggaatgccatgaccagacatcacagttctgacaggcaaggaccaaagactggctctcttagaaaatggttctactagaaacatgggaccagatataactgaaaatattccagtcacaaatgcacaactgagactccagattgccatttagtatgctttgtattgtagaatataaaactagccccctctacggaatgttatcgtgacccccgaggcagtcacagcctctcctgactcggtatcctgctattttctggttgtaccaaaaaataaacaaccggtaaatgacttaacctcttaaaaaatatttatacttaaataatgagatgagtttggatttcctcaccttttaaaaatgttgctagagctactaaaaagcttgcatttacaagtagttgataaaaatattcctctggattgtgcaagaagggaggcaggaccactgacagacatgatggatgcttagtcggacttggcttctttctctttttcagaggctgcactctggttttctgtctctccattttctgcaggcagttctctagtttgctggtcagccacttcagcctgtttgcccttctctcccctcttcccttttatctgcactttttttgtctgatgctttattctttcctgcagcccctttgggcttcctgtcattgatggggcaggcttggctaatcgccttgcagaatggtgcttggggtatgccttcactgctcca

SEQ ID NO: 14 - DNA, 25525 bp, Mus musculus
tggagcagtgaaggcataccccaagcaccattctgcaaggcgattagccaagcctgccccatcaatgacaggaagcccaaaggggctgcaggaaagaataaagcatcagacaaaaaaagtgcagataaaagggaagaggggagagaagggcaaacaggctgaagtggctgaccagcaaactagagaactgcctgcagaaaatggagagacagaaaaccagagtgcagcctctgaaaaagagaaagaagccaagtccgactaagcatccatcatgtctgtcagtggtcctgcctcccttcttgcacaatccagaggaatatttttatcaactacttgtaaatgcaagctttttagtagctctagcaacatttttaaaaggtgaggaaatccaaactcatctcattatttaagtataaatattttttaagaggttaagtcatttaccggttgtttattttttggtacaaccagaaaatagcaggataccgagtcaggagaggctgtgactgcctcgggggtcacgataacattccgtagagggggctagttttatattctacaatacaaagcatactaaatggcaatctggagtctcagttgtgcatttgtgactggaatattttcagttatatctggtcccatgtttctagtagaaccattttctaagagagccagtctttggtccttgcctgtcagaactgtgatgtctggtcatggcattccactttcctaacagttgtgataatgtgatgtgaaagatggaaattttcagtatgtcctgtgtgtgacataaaattgtgagttggtggaagggggtattatgaacattcggttgttatgagaggtcttagggacacttgccaaatttgaggctggaacatcactggaataaattcaaagaagaacaatatgtagatcttcatttgtgcatgtgaacacagtgtgactcttcagaatttgggtacatgaacacaatatatggctctttatgggtatgtgtgataagaatggtaatgtctgtgtactctgctcttagaccaataaaatctgttgagaaagagttaataaaacaaaaaagaaaagaggagaaaaggaaaggaaaaggaaaggaagggaagggaaggaaaggaaaggaaaggaaaggaaaggaaaggaaaggaaaggaaaggaaaggaaaggaaaggaaaggaaaggaaaggaaaggaaaggaaaggaaaggaaaggaaggaaaggaaaggaaaggaaaggaaaggaaaggaaaggaaaggaaaggaaaggaaaggaaaggaaaggaaaggaaaggaaaggaaaggaaaggaaaggaaaggaaaagaaacctccatcagattacttgtaggcaaacctgtagggtattttcttgattaatagctgatgctggtgagcagcccatagaggatggtgccacccctcatcaggtgcttcatggtgcgttaagaaagcagaccgagaaagccatgaggaacaatccagtgagcagtgttcctccgtgcctctgctttagttcctgcctccaggttcatgacctgaagtcttgtcctgacatccctcttccccgcccccccacccacacacactccatggagtaagacttgagaggactgtgatgagtaaatgttttcctccctaatggttttgaccctgatgttttaccacataatagaaatgctaagataccccactctcaagttccctgcatgcttcttcattcaatctgtcttctttgtaaaattttacttttacatctctgtaactcttctaaaacctttttgctttctggctttttcccccaagtaatatacttttcagttctcaggttaagaacttctgtaacttggtttcttgatgttgaagacttgaatgtaaagagaagagatatttctgatgcagtgtggcatcccagtactctcaagctccctgctaagtcttcactcgcttttatttatcatcaaggttttgggatcttcatcccctgcctaaactgagaacagtgtgatactactctattatagtgtttttctactttatctatgtgtcccactattcagaaacatctttcttccccttggtcatcacaagcaacaaatattcaatagtattagcacatgatgtcccttccgaatactcaaacattataatccagccatgtttttcaaattttaagatatattttttcattctttataatcacatgcctgtatacaatgtattttgatcatattcactctctcaacccacttcccaagttttcccagaaactcctacctgatccttactttatagcctctttttttgacccataaagttcagctagtactcctcatataagcatagatataagatcaaccactggagcacaggcaaacctctaggagccacaatctgaattaaaatgaaataaaaataaatatataaataaaaactgcctttctctcattcagttaccaagcaaattaggagatttacacaatttttaatgcctcttctccaagtagcccctcctccattgagagaagatttctcttctcattttacctgtcccaactcctcagtggatgcacacaatcaaaacttagatttttcttggtcatgtagaaaatactaagttcttttacagctttctccagttcaggtaagaattacatatgcatatttattgttacacataatatataattttatgaattacatttactggtgcaattttaatacccagccttcactaaaaccctagtagtgatgaggtttaattatttcctttaagatttgtatattatataaaagcttcctacttagaggctctctgagacttttctcatccctagggggaaagaaaacaaaacaaaacaacaacataaaggaaatgaaatttaactaactttttcttggggaaaagttgcaaaggtggacatatctccctgaatatagaagattatgctccagtaatcttgaggaaatagtccaaggcctctgtggtacttgtgagctagatccatggttacagaagccaccaacacctgaaaagcaacctgcactgctggggtgaattccttgccaaaatggaggaacagcacaaatgctattatgtttcccaagaactgtggagaagagcacacacatttacccctgggtatcagaaatcaagctagtcttttaaggaattgcaccaacactatgaatttccaggatatttcttctaaaatgtgtgtctttatataaatgtattttttatataatatttatatttactacttaattgattagttcgatggtgggctcctttttaccatctactgttaccccatctctaatatgaatttcaggtcttccatccttagacattaactattctttccttatctttgcactaaatctttgcctaaattcatgaaattcttattatttaaagaatgattcaaagactctagaaccacacgtgcctcttcattaaggagactctcaaaagctcaagcaatggtagcagtaagaaggatgttttccagatgtagatatagtagatgagagatagtatgtataactcaggaggtgatcctaccaaggggatttgaagatgaatgaaggaagggaattgggggagagagagaggaagaaggaggaaaagatttgttaaagaagattatggggggggaagggaggaagttgacttgtgaaggaaagttagccaaagaagagtgttaagtgaagaaatacagaacagtagaggaaactgtggggaaaaaggcaaatggaaaaagaagtgacaaaacgagcagaagccgaagccagagcatctggcccactcaccctgaagttctcaggatctacatgcagcttgtcacagtgcagcttcattcatgccagaaaagatgcccttgaggatggccaggtgtttcaggtgggtagagaaaatcagttcctgccagacattctgctctctcttcacctaccaagcttccatgtgtcctgcttatgcagcccattacgacttctccagtgactcgccatcaatgtttcccatgtctaccatgtcccacaggccactgatggccaacttctctttgtcagtcagtacaccctggtgtaggactgctgctagtgaacaacctgtgtcagaagcagatgcaggcacagcaggcactgctctacctttaatgcccatcccggactacctgacttccatgtaatgttacttgcatgtatgttttcaagtctgaaggcttggtgtgctcttctctggggaagactatttctctagctctcacactctttagttgcccgttgttctttgttggaggggctgaggcccaatgggcttttccctatctacgttagcatatattgtcattgtctttgtgtacccacataggtaattgtggtgtgactgttatgagagcaactaaccagtttctgatggaatttaaggtctgcttcacaagatagaactcatgcctggtacagttatctggacccaaaacattgctgcctaagtcataaaggaaacactaatataattattctcttaaataagcataaaagtaaatttctgcctaagtacttacccctatatacatagaataaaacatctttcaactctcattagagaagctccttcctttgtacagataccaataaattgagaaacaaaactggtcaatccgcagagaaagattgtggcagctcttaatggaatacctatatcacacctccttcttccaaggctcaaggataattttggaagagaaaagtgtgaaatattttaagagccagaagtagtggacatctacagcaaaatggtatttgccatgaatgacaaggcaaatgactgggcttaaatataagccatatgaagttgggaaggaaagggggcaggtgaataagggaagacttgaatgggaaagactgaagggtggatttgatcaaaccattgctatggatgtatgactctctcaagtaataaagggaatgtagctgtttctaaatatgtatactcaagtaaattaatataactatcttagtgtacaaactagggatggcatgaaattaaaaaaatgaagatgaatcattttgattgccttcatctctagcaaagctcatatatgcacacaaatgggaatagccatatggccaaataggagagctttttatatctacttagtaatattttatttatagctgcaatgatttttatatcttttatatagaaatggatatagagaggatttttttaattggtgtagagggacagaatgtagagattgagaaaatgccatctagattctccttcaataaagaatatttgtgagccaatagtactgcatacaactctttcagcatagtcaaatatccaattggtttcaaagttggagatctgacctggtaggataccttgatgtccagtatctaaacttccaaaaatcttaaatagtaagccttttctgtctcgttggacatctaggatatatatggtcttaggtgcaggaaaattaaagtcatcaccttactagcaatctaggagttatttttaataatttctctctccttaggcttttggggctatttcttccaaagataaattaattgctacatgtctataaatgtaccatccattttccacatgccattgctcatacctgaatgctcacctacaagcagtttctggggttttctctctttttaaaatttatttattcacttcgcatccagatcatggtccctgctccctcctctcctcccagtcccaccctctcaaatccttcctcccattacccccttccattctcctcagagaagggaaaactcccacttaggtgccacacaccctgggacagcagattgcaccagtactaaatccatgctttcccactggggcccattccaggtagtccagctagaggaaagggattcaaaggcaggcaacagagtcagaaacagcttcttttacaagtgttaggggacctacatggagaccaaactgcacatctgctgcaaatgtatagggagcctaggtccaatccatgcatgctttttagttggtgggtcagtctctgtgaaccctcatagccccagttttgttgactcagtaggtcttcttgtggtgtcctcacccctttggctctctcaatcctctccctcactcttctgcaccacttcctgagctctgcctgatatttgactgtggatatctgtatctatttccatcaactgttggatgaaggctctctgaagacagttatactaggttcctgtctgtaagcatagcagaatatcatcaatagtgtcaggggttgactctctcctacaggatgggtctgaaattgggccagtcattggttggccattccctcagtctttgctccatatttatccctgcacatcttgtagaaaggacaaatttggggtaaaggttttgtggaaaggttgatgcctgcctcctccactggaagtcatgcctggttacaggaggcagtcacttcagtctccatatcctcagttgctaggagtctcagctagggtaaccaaccccctagacttctggaaccctcccctttcctaggtctctggctagttccaaagatgaccccactgatttctgttccctctcccagccctccccacctcactccacctcactcttattccccagacctgatccccattcctattccttccttactccctctctcacccagtttcttcccccctggctcagccattaaagactacagtttcatattgtaacaaaattgtatatattacagtaataaattactgtaataaagattacagtttcatattgtaacaaacattcattgaacaactatttgttgagtaactgtatcataatggtttagccctagggatttatgaaatgaaaaacaaaattaaatttttcttctaggctcataaactaggagataacaaatatggaaaatgaaaaaaagtaaatcaatcaaatatttttaatattactttctaagaagaaaattaacagtagggattcataagagtaggacatggctatatcatgatcattctctctaaggatgaagttactattctatatccaaatgacctgtcacagaaaaatattgtggaaaaagtattttatatgttaaaataaccaagtcagtattctgaaacaggaggaaaaaaacaacaaatttatatactatagaaactaataaataatggtcctatgagggaaatatggaaataataaagtggaacctagcaggttatgttgttgcccataaacatggtaaaacttctcttccagggtaggaataaggagctgtgatgacatgacctctatacactatatattcctaaaagaaaaacatccccctaaattccatccttctttaacatctcactcttgtgatttttatctgttcagaaatatgggctatgtgaaatggctctgcagttgccctgcatctgggagatctagaagatactttctatctacaaagcattctcattgtctgttataagctatacactgagaaggacagattgaacacgaaacagcctctggactcaggcttgctaccaacagtgcagtataatgtggtcagtatatcctgcagtataggcagatttactacaacagtattttcacatatatataccatatatatgaatccatatatgagggtgtgtgtgtgtgtgtgtgtgtgtgtgtgtgtgtgtgtgtgtgtgtgtgtgtgtgtgtgtgtgtgttttctttaggagactgggtgacttcacaaagaaagaggagccaggttctgaataacaagtacatctaaaagcagccaatcagaacataattttaaggaacacatgtgagtcagaaatttttaaaaatcttgctaatttcacatatagcagaaagagcattcaaagaaagaaatttttctacacatgatcagaattctgtggtttcttcctttttccttcctgtagtttgtagcatttatgagtagagctttataatatcctataattattctgattagctccagccataggtgtttcagatatattgtccatgattatttcattgaattaatgtcagcttactacctatatagtaatttaattgcaaaatacaatttaatagcaagaaagattgcagtataaatctctcccacaaagcagaaatttgtaaagcatgaccatgtgttcatgtatagaagagtgcatgtgtgggagtgtatgtgtgattaaaagagcaatttgaaaagttggtagagtgagaatgttcacaatgatttctttaggaagtattagttcattgaatgaggggccaacataattcaagagctaaattttaaattggtatttgggagctagtaagacaaagaaggtatatatatatggcttgttatgttatagtataagctaaagtctacagataaaggaagaatcatggcaatgctttcgatagtcattatgcattagattggtgctatctatgcatggtaattgttggatcataacagtagccagccttgagccttttacccagttggaagtttctcataaatcttctaaaagggtaagaccctctctatatgaaacacttatgacaaatcctatggttattttttaatattttttattatgtattttcttcaattacatttccaatgctatcccaaaagtcccccacaccctcccccacacacacacacacactcccctatccacccattcccattttttggccctagtgttcctctgtactggggaatataaagtttgcaagtccaatgggcctctctttccagtgatggccgactaggctatcttttgatacatgtgcagctagagacaagagctccggggtactggttagttcataatgttgcacctacagggttgcagatctctttagctccttggatactttctctagctcctccattgggggccctgtgatccatccaatagctgactgtgagcatccacttatgtgtttgctaggccccggcctagtctcacaagagacagctatatcacggtccttgcaacaaacgcttgctagtgtatgcaatggtgtcatcatttggaggctaattatgggatggatccctggatatggcagtctctagatggtccatccttttgtctcagctccaaactttgtctctgtaactccttccatggatgattgtttccaattctaagaaggggcaaagtgtccacactttggtcttcgttcttcttcagtttcaattttcaaatcctatcttttgccttcctttagtatctctatagagttttcttccaactatttgcataaatacagagcagctttttccttgtagatcttctattgtgttgcacatccctaagtgggaaaaatgaatgaaataagtcatgaaattatttattaagcagattctatgccatgaggatggacacccccccccaaaaaatacaaacttcaaaacacaggattctagagaaggatcttccaatgaccatgcgaaagaaggggtctcagtaatacttgtaagccatagcatctgcaacagcagccaccaccttctcaaaagcagcttgcagtgctgaagtaaagctgttgccaaagtgtggagacatcacaatcactatcatgctgcccaggagctttgggaaagaggaagacagacatgcatatgatagggaaattaatcttggcttctgaagagccataccaaacaccatgagtttctgccaacattctatcccagtttgattcctagataatttcttccaaaataaaaaagtaaatatacatgtgtgtttgtgtatataagtatatgtacatatattttatctatgcatatacttatatcctaagtgtatgcttaataatcagttgattaatctgatgataggctctctctttaccactattgttccaactctaacaagatgttcagaccttccttccatccacatattttttcctcatcttaacctttactaatttcatggaattctgattattctttttctcatgtctttaaaaccagatgttctgtttctcttccttgagaagactcataaagcctcctatattagggggagatggaagaatgtttccccaaatctagaattagaaaatgaaaaacagaatgtgtcatttgacttgtggtctaagcaagggacttgaggataaatgtaggtagagctgtgggtggagcacaaaagacaggatataaaataaatacatttctttaattgaagattgtgaaaggggtaaattaagaaggatattgaacaaaagttgaaaatcattagacgattaagtgtaggcaaatgaaagagaaggtgggggatgcagcagtaagtagaaatcaagagcgtgagcagaaggcagcacatctagccaactcaccttgaagttctcaggatccatatgaagcttgtcatggtgcagctcactcaggctggcaaaggtgtagtgcaggttgtccagggattgcaggtcctcactaaaggattctatcatcttcttaccaagagccttcagcttgtggttatcttcagtggcagcacagaaggagaagtctccaaagtggtcaaagtatctcttggtgtgtggataaaccgtcagtattctagcaagtgaagcatgaggacagagaaattcagtgcctccacatacctccttccacttgctcccttaggctgtcggatactgacctttccagggactcaacaccaagttcttctgccttcaccttagtccacgtggcagtgatggctgccttctcctctgcagtgagctccaccatagtgtttcagctgaggttgctagtaaacacatctgtgccagaagtaagtgcaggcacagcgggccctgctcttccctttatgcccagcccagactcctgccctccctaccctatgagcaagttaccttaagatatgaagaaattatttggcttgtgaatgaaagatatatccacactctccagtttacactagctggctgtagtgttggctctcctaaattctgtgttttgatgcagaaacattaatccctctgtttatctcccatcgggttcacctattccttgttcatacagccaccagctacacgcggtctcatccttttctatgattcagtttgatggagtggaatgtgggatgaaattcttatcaagttgactctagttcctctttgtctctagaaatgtgtatcttctgaagtagctagatgtaagctaatttcatgtaagcccatgttacaccccattacaagatctggaccactagatgctatagcctttatttctcactgtgccagtggaataacctttacaaatacctaaagaaagtataggtacagtagctcctgtaattttttttcaggaatgttcccaactttcactcaattccccccttttctttaatgtctcagtctcacaagatgtaagatagctctttcagaaatataactaatcaaaaacaatactttttgttcatattttaaagtattctcttaaaaatctctagcagatcttgggctagagagggagctcagtggtaaatagctctttcaaaagaccagacttcagctcccagtacctacttgacagttcacaattggctgtaactcaagttccagaggatgtaattctatattgtggcttgcaggagcaccacacacaggtaggacacacacatgtttatgcaggaaaaacactcactcatatgcaaaaagtgaaacttaaaaaagaaatagcacatctcaccagtcttctttacctcctggcacctgcaaccctactttttaccttgcacagtaaatattttgtaccctatcttatactgaacagaccctttcatctcttcctggagaaaactttctcatctttaacttagctctttccctaatacttcactctatctggtttcttcttctgtcttttcccaccaacaagcccattgagatctttcttcaacataaaagtaaaaacaaacaaaaaaaaaacaaaaagtcaatgttattaagaatcaattttattaaacaaaatttgtgctctcaatgcagtccccatggactcaaagagggcatcatagacacatgggattgccagtgtactggaatggagtttaatggtacttgtgggacagagcattggccactccaatcaccagcttctgccaggcagcctgcacctctggggtgaattccttggcaaaatgagtagaaaggacaatcaccaacatgttgcccaggagctgtaacaaaaaggcacataggaatgatcagtagtttcaaatctgtgacgtgtaaaagttacgttccttgaggattccagtccctcactacctatcacttctcctgttatgcatttgacaactgaattacatgactcctcttgtacaccactcaactggctatatctgtacctttcctcattctgccctttttatctcctcccattttttgctccctgtctcattcatcaatggtcaaatctaaatcaacacatgactgcgatacaagattcttagtagatttgagtgttcaaccaaagagaaggctcaaactgtgccaatgctcagtgggaaagtaaaacatttagaaagttgtcaaaataataagaaaaaaaaaccctatattttgatttcctcctcgagtcttccataaaggattggacattaagattgacacaattaattaaggtatttttcctttcaaatgataagatattaacttaaattcagtttcttcttgcatagatgtattaatttataaaaacatactccttttttaaaaaattccaatatttgaatgcttagtttccaatgctcagaatcaaacccaaggccccagaaatgctgggagctcactcaaatctgcacccaaatcattgttgcccagaacatatgcacagctaaatattaagatttctacaacggttactgacaagaattctggacccatggactctaacctctgtcaaggcattgccaagcacagtctcaactccaagtattgtccctagtaaaatccataatgaacacatgagcatgctcagaactgaccttgaagttctcaggatccacatgaagcttgtcacagtgcagctcactgagatgagcaaaggtctccttgaggttgtccatgttcttaacccccaagcccaaggatgtcagcactttcttgccatgggctctaatccgggggtttcccatgatggccagggcagaagagaggtttccaaacttgtcaaagaatctctgagtccatgggtaaacaatcaggagcctaagacatagggcattagcagttaaaagttagtgtgccacaaaaccctatagaaaccctggaaatttctgccatgcacaaggacaatttccctccattccttaccttcccagagtttctcctccaactttttccaagtccactttatcccagatgcttgtgatagctgccttctcctcagctgtgaagtgaaccatggtgtgaggtatagaagcttggagatgatctcaagtgtgcaaaagcaagtgtattcaagaggctgaagacctgtccttttattcttcaccctggaccttgctccccttacccctccccaggactctgaggctattggtcaagagagtctgggcaagacaggggtggggtccagtggggtaagttctagatagcaatgcactaagatagtgtccagtaggccccctgcctcggagagacagagcctcctgctgcagctttcccagagttcaccgtctttctttccttctttccttctctttagctccttcccccaacaggagatttgcaagggtgtctttcacattcttccctttttcacttcagacttagagggattaatacatttaagttgaagcataggcaaacatgggaacgcctcagtgagccagaggctatttttaggaatggggttacgaacctaagtgatagaaatatgagtcttactcacaagccacgtataagaaagatgtggtgtgcaaaaccattgaatgcattttcagtaggcttaggacatgatcttcttatttcccacagccccaggaaagccattcctaatacatttcagtttctaagtaaaaatatatatatatacacacacacacacacacacatatttataacacacacacacacacacatatatatatatatatgtattactgtgtagaagtacaacatgtctccacattccatcatacactaaagtagagaagtctgtgtacatgacagcattttccacccattgaatgcacagtgttgacaccatacaattggcagcccccacccacccacccaggataagtgtagctgcctggtgaaaagggtgagggtttagccttctctatgatcattactggttaaatactgagaacactaaatgatcaagctttcaggtttcttcaactcagctctgttttcactttttgtgtgtttgtaacctaactgtgaagagacagggtatttccatgcagtaacacatgcactatcacagctaggactggattatacattatgaagttcatccctagcagtgagtttctactgacagcttttaaggttttgtagctattttaacgtagtggtcaatagagatttttatttgcatggctgtaaagaacatgcaatgttaacaagaaccagctatgttctcctcttcttcctcttcttcttcttcttcttcttcttcttcttcttcttcttcttcttcttcttcttcttcttcttcttcttcttcttctccttctccttctccttctccttctccttctccttctccttctccttctccttctccttctccttctccttctccttctccttctccttctccttctccttctccttcttcttcttctccttctccttctccttctccttctccttctccttctccttctccttctccttctccttctccctctccctctttctccccctccccctcccctccccttccccctccccctctccctccccccctctgtttctttcttttcactgataaatcttttttttttacagtctaattgttatctccctccccgtctgccttctgattgttcttcatcccatacctcctcccctatctccaagaagatgcctccccactcccactacaccagacctccccactccctgggacctcaagtctctcaaaggttaggtgcatcttctctcactgaggccagacaaggcagtcctctgctgtatctgtgtcagtgacctcatatcagctggtgtatgctgcctggttggtggctcagtgtgtgagagatctcaggagtctaggtcagttgaaacttcatatagggttgccctcctcatcagcttcttccagcttttccctagttcatccacaggggtccatgacttctgtccattggttaggtgtatgtatctgcatctgactcagcttcatgttggacagccatgctagactttgtctgtaagcacaccataatatcagtaatagtgtcatgccttggagcctccccatgaactggattctaaatagggccagtcactgaacctttttttcctcaggctcttctccattcgtcccacccacccattcctgctgcctctctgtagaattatccttcagtattgggtcagagtttatgactgtgggatggcaacaccatccctacacttgatgccctgtctttccactggaggtggactctacaagttccctcttctcattatagggcatttcatcttaggtccctccctttgaatcctgaaagtttctcagctccccgatctctggtaccttctagagctatgatcttttaaaaggaagtcattcgtgagatggcaaatatgtacatatatattcctttagcttctatctccatgatttaatcttggaggatagttggtagtcctgagtttaagcttccaaatatcttaaccagtaaccctaagttgctcttcagcagagtcttgggggaatttcctacaaagttgtattaattagttcatgtctattaatagaccctccataatccccatgtcatgttagtccaggattttgaaaccgtttctttatgacagctaattcatgtaatctcaaatgttcactcaatcattatttgtctcataactatgtgataattattattattagtcctgggatcttttgtttctcttttattgattttttaaatttacatttcaattgttatcccctttcccatccccccaagccctcctatcctatctcccctccccctgctatgagggtgttcattcacccacccacccattcctgctgcctctctgtagaattatccttcacaagtcctgggatttataatgaatgagagacaagacagaacttttctctagcctcattcactaggagatagaagatacagaaatgagtaagtatatcaaacaaaaaagattttaatatgttattactaggaagaaaattaacaattgggattaacaaggacaggacatggtggtatggaattcagtttctctacataatgaagagttaagtttgttgtgtccagaatgtctagaagtaacatgtcacagaaagatactggaaaatgttgtaatagcaaattcagtgttctgaaggaagagaaaataaatatttctgtgacagtgaagctgataatatccatgatcactaaatataaaaataataaagtggaacatggtgggtgtgttgctgcagtgctcataatctaacagaggaatccatcttccttaataggaatgagaaactataatgacataacctttgaatactactcatttcttatgcactactattctagggtcatagtacttctctcaaataatttttattgcaaatgtatattgactatcataggctgcacagaatagcacatgcctttaatcccagcactcagaagaaggaggcagacacatctctgtgagcttgaggctagcacacagtctacatattaagttctaagccatcgaagctacagaagaggaccttgtcttgagaaataaaacaagcaaaagtcttttatcatcctacctgtatatgtgaatgtgtgtgtgcacatatgaagaactatttttcagttatctctttttttccattggagtggttataggtatatatagccctgaaacatttggcaaatatactttcctcccaccactgcataattgccatcttttatccgctgatttctagagccaaaatattcatgatggcataaggagaaaagtaaatttataaaaaatgggcattgtctcatctcttgacaggtccagagaaaacgagtgtcatatacaacgcctgcatttttgttgctattgtttgtttggtttggtttgttttcctgttaattgccatattgaaatgctgtagaccaaaaaggccaatgttgttgatagcctaaaactacaagaatcattgttctttcatatttaaagtggacaaagacaacttgaaatacaatccaccagtcatactctaaccaatctatggaatcaggatgagggaatatagtttagtagctaaaatgtggttatcttacctctaccacttaaagatcaccagccttgacaagagattgactagggcttgaatttctttgagcacctttaaattctctcaagtgtgttttatccacatgagttttccaagtcaatgtacactttatgtagttatgtccactcagtatttgtgatttcatcttctactatcttctgttttcttctcatatattagagttaatctgacactgtctcccccatcccacctttgaacattacctcaggttgcatgccttgcttcacctcttcattttaaacttttatatctctgtaatggttcctaagcatttaagttaaattggatccttaagaatatttttcttagtaataccatttcttgagtcagaaatcctgagactgcttattctttactaatcaattcagttggtgtcttttgtttagtgctagtggatcttgattccctagcagtccacatgttaggacagtgctctgctctgagcagcaccctcagaccaggtttttattattcattctgaggtagcaactcattgagttctttggttgtccttgaactcaatctgttgctcaggtaactcttgaaactgtgacactttgcttagcctttcaagtagtggagtgataagcatatttcaccaggtaagtgttattgtttaatgcttaataaagtattaatattgagatttttataattaagatccctattgtctacttttgccagtattttatctcttcagcatcttctagttttatacaaatcatcaagatctagttcagtgaccttaaatgacagaactttttggcatttttgtagatgtcctgtgtatgaaattatcatgcccacctgtctggagaagattccatttatattctttccctatcataatcatattgcttattacagtagcacagaaaagcacagtggtcgcatctcttagctttcattcctccttgagacaaggaatgccttcaaaaaacaagtctgaagtggtggtttcattgaaactttttcttatatatttaatgctttctatcaacttgtcccttttctttcatcagttccagaggacatctgatatagtatctgttggagaatgttcatttagcgtgggagagatgatgactccgtgtttgagagcaaatactttcctcagagcacctgaattctcagcatatacagctcgcaaccatctgtaactccagctctagtggaacttgatgcctatagtctcctatactcacgtgcacaaacccaaacacagataaatgcagagatacttgattaagagaaataaatcttttttttttaagtcagctgctgtgtggaacctctaggaagatggtgatgctaggctcctgtctgcaagcataagtgagtatggggtcaaggagtagtgcttgtccatgggatggttctacagttgggcctgttattggttggccattccctcaattcctgttccctctctgtttctacatttcttgtagacagaacaaattggggtcaaatgttttgtggatgggttagtgtccttattcctccactggacttccagtctggctactgtaggtggacttttcagattccatacccccactgctatgagtctcagataaggttacctcccccatgaaccctcaggagcctcccccatctcaggtttatggcacattcttgtaatgttcccccatacctacaacattgccaactgcagatttccattcattctccaggccctttggccccctctcctgtctcctcccacacttaaacctgaacccctcctggaaacgaatgccaacattgaatgcagcttgggactcttatgtaagatagagggactctaagggaataggaactccacagaaagaccaacagagtaactaacctggactgttagggggtctcagagactgtaccaccaatcaaagagcttatacacgctgaacctaggtcccagcacatatgtagcagatgtgtagctcaatcttcttgtggttcccccaacaactggaaaatataagcctgtctgtctctaaagctgttcactgtctgtagaatcaattcccctaagtggatggccttgtctgacctcagtgggaaaagatgtgcctagtcaggaagagagttgatatgccagggttgtgtgtgtgtgggcggggataccctaggaggggatcaaccctttcagaggagaagaggcaggatgtgagaagaaattgtgtgaggggggatggggagggggcaacattggagatgtaaagtgaattaattagtggggaaaaaagaaaataaaaaagtaaaaaaaatcataataaaagtaaattattttttaaaataattaaactgattatctcaggttgagcattagatctgtctaaagtttaacttaattaaatggcacataacacagactgtaggtgatcatttgtcatgcatttcttcaccctctacactaagttttagtgactaccacagaacttttttctccacggcattaaccctttgctttcctacatgagaattatccccaacttctcatctttcctggggctctagaaaaattctgtaacatctactttcctctcctgaattccagcaaagttctaaaagaaactcaagcgtccttctgtctcgctcccttaccatctgcccatcagccttctttctttaaacacaaaagtaagaaacagacacaacaaaatatgactcatgggttactgaaaagaatggactttattaagcagaagccctgctttcagagaccagcacagtggccatgggtatggcagagctgaggggtgtacagaatgctggacatcagggaaagggctcagtggtacttgtgggacagagcagtggccaccccaaccaccaacttctgccaggcagcctgcacctcagctgtgaattccttgccaaagtaagaagaaagaacaatcaccagcatgttacccaggagctatggaaggaaacacaaaaagatatacaaaaatgagaaaaggaaataaagaaaagaatttacaggacaaacagcatttgtaagttagtctccttgaggactccccagcagtctgtccactctaatgaggatgctggttcaatctcattgctcaagggccctcctcgaccccattcggtccttctctacttgttccttacttttcctcagtctgccacttttgtttcttgccccttttctcattcaacaatggcctggcttctacaaatacaggattaccatgtatttactagagtttcctataatgaaggaagcagggactacttatgatattactcattgggattgtaatattttttaggaagttcatcaaaccaatgagaaacatctgtcaagttttctctcgtatttttgctgaagggttagtcattagaatccacataaatagggtatttctccttccctagaacaaaatgtcaatttcaagggctagtctacttacatgtatctgctaccttctaaaataaaacacaaaagtgaggaggattctataaccaactctataagtctgctactttgtgtctttttggtagtgctccagtctcaggattcatataccccagagattcatttcatcaactgacttacataccgagacaccaaatgtctgtctgaaaaacttttctgaacagttgcaaattttaattttaattattttaaaaaataatttacttttattatgattttttttttacttttttattttcttttttccccactaattaattcactttacatctccaatgttgccccctccccatgtttcaaaatcgtgtcattttgccattgtaattgtatgtatgtgtgtgtgtgtgtgtgtatatgtataagttgtagtcttctcctctcatgtagaacactctttgcaatagacaaagaccagtacagaaatccacaaccattcaaacttcagagttgtggagcctaacctcagtggatacatctacacacctaaggatcagggaacacttcagaagaagggcaaaagattgtaagagccaaaagaccatgaagcttgctgtgatacacatttgctaatatgggtggggtaaataaagcccatgagacctcaaccatacacaaagaattacagtcaactaagggttgctgagagctggatcaagagtcttccccggggcagagcacaccaattggttacccaacaaatgcttttttaaagaaagttaattctaaattagctcttggatcttgtaaaagctttttcctaatggtaatgggatgtcacaacctgctgcaaggtatcacttgtcacccttttcttcaccctctacagtaaatgttcatatgttccatacacaatgccttctccactaaatttctttcttctctctgagaattctttctcagctttagactctcactgggcctgtagaagccttccatggcttctacgtttctctcttgagtccctgcaggtttcagataaatgcctgagtcttcctgtgcttccccctttccaaaaacacatcaaatatgtgtctttagcataaaagtagaaagcagacaagacaaaactgaatttttgattaccaggaaggatgatctttattaaacatgatgtgctttcaaggaacagtccagtattcatgtgcagaaaggaggcatagcggacacacaggattgctggacagctagagagagggctcagtggtacttgtgggacagcgcagtggccaccccagccaccagcttctgccaggcagcctgcatctcagctgtgaattcattgccgaagtgactagccaaaacaatcaccagcacattacccaagagctgttgatggaaagacaaaagaaacaaatcggtgtgttaaatgaagatttgaaacgaataagcattaaaaaaacaaagaaatattttgaacccatactctttaacacattcagcatcaaagcttcctcaatcatctctgatgagcagagattccatttttctattgttcctctttttttcccactcaccactgttctgcctggattctcataccttctattctcagcatatttatttgcctgtcgttattctcattctacagttgtctagtatctgtaaattcagaatttgtgttttcctactgctgttggtggagttttaaaactacccccaatgtaagaacaagcctccatttgtcaagatattcacctggaaatttaatacaattttatgtttattgagaaaattcaccataaggttgtcttgcaagacttttcttcaacatcaatcaataggacccacaaaaagttaagatttttccactccctattccatttcttcttgcatagatctactacttttcatattactctccatgataaatccaagaaaattttatcacgacaaaattttctaaatgtttgtaaactaatttaggtttcttacagccattcactgtcaccctactgggaccaattaattaactttgacagctaagtaagcacccccttattcatattcttggcttctcattttgtccccgagacaaatccaaaataaatttgtggcattgccctagactcactttgaagttctcaggatccacatgtagcttgtcacagtgcagttcactgagcttggccaaggcagacttgaggttgtctagattcttaatggactctccaaaagcagtcagcaccttcttgccatgggctttgacccttgggttgcccattatggcagaagcagaggacaagttcccaaagctgtcaaaaaatctatgggtccatgggtacacaacaagaagcctgtgaagtggagaaagacaagtagaaatataagggagcctcagaattcttgatttccctagctctttgtaccctaaaaacaattcttaccttcccaaggcttcaccaccaacctcttcaacattgaccttactccacaggccattgatgagggtcttttcctcagcagtaaagttcaccatgatggcaagtctgggaggttgctggtgatcacaggagtgtcagaagcaagtatgtactgctgctagaagtggtggccttttatgcttcacagacaatgttctgaccctttgttctgcattattctttgaagctattggtcagcctgacccgtggtcctcatgggtggagccaggtcatgggagggtcagcaaaaactgtacactgtgtttatgataatgcacattagatatggaggtattctttcttttttggctcctccttcaacaaaaactctctttgttttgcttattctcttttcattttctactctccacatgtaaactcccagtataacgcccatttctcttatcactttttccaacaaaggcacagaaagaggagtttagcccactataggaaaaaaaatccagtctaaaataactttaccgtttagggaaagaatggctataataataagaacaaactcatgaaaaaaggaatttgtgctgtggacacagaaatgccaatattacatctgtttctccttttcttgggatatgtgctttataactctatctcctagatatatattgccccaagtagacaagacttatacatagttgcatctggaggatgaatacagtagcaaaggattgacaatgggtccgaagactcaattccaaaatacaacaacaggaagtgacagtgtagagaagatggatataacaagttcttgttttgtgattctagagagttctctgaccaaacctttgtgaaccttactccgttagtaatattgctttgatctttttccttgcttaatcccatatagatatttctcatctgtgaggtggaactgaaataactttaaactaggcttgtgattcaactgaggaatgagtgagttgattcatcaatatccttgagaaacatttgtggatagtgtttattataactaaaggatggctagtgtgcttgatttctaatctcttcttggaattattagctatctcctacgtattggacctgaaattaaaagcctacatttgtatgtgtttaactgcatccatgtgcatgaaggatagttttacaccatcctatttaatctgcatctggcaagacagttatcattatccaccttttattcaaataaacagaatcacaaaagtgatataactgtaaggtgagagaactgttgaccaagggaggaaggctccagatttggtcacagtttggctttcctatttataggaaagttgtcctccaacctgcctctggtcagttctgcctgcatttcttccttttacctcctctatggcttcttgtgctcctaacccccctaagagtttctcttccaagactttcattttatttagtttagttctgttttattttttacatttgtttgtttttcttgtggggcccaagtgatagtgcctatttttcatttagcaatgtggcttcggtgtctcaaatctttgtgttccaaatttacccagaggatcttctctataacctttggcttgccctggcttttatgatgatttgttatgtgtctaacagccatttctgacatatgagaacacctttgttttactttcttctatgcttacagaagcattatcttgtttaaagtgtccccaaattggcattattacaagtaattgaatctctggccctctgtcagctttttctctacattatcttttgagtacagattctaacccatggccagtatagatgtgaacttatcttctcatggcatagactatttggcagactattacctactaaataatgtatatacataggattgactagaatatggatactttatacatgttaaaatagctacgtttggtgtgatgcaccttcttatgaacacattaagctaacaggatgaccatggtatccatgtcatacagactgaaagtaagcatatctgttacaactagagcataacattttaaaaaatgttctgtgggttcagtttaaagttttcttgcctataatagacagcctaggaaaat

SEQ ID NO: 15 - DNA, 25454 bp, Mus musculus
ctaaaggaaaattaagaatagtactcaattaaaatttttacatatgttatttgctattgtagttctacgatacttaaattctctgaggtatgtgtatctaaatccaatgatttttgtagcctccctgtcttaagcaggctgatttagaccttgctgccactgagaatgagaccacctggggtggagccttccaacctagatggttctattgttctgtcacctgccactgctcttctccaagatgctcctacccactgagaggctgaacctgtcttcctgagatattcctgagatagctgacaacctgtggaattggtgacataatactaacagttagggcagactagtgctaacaacttagcaacaaagtctggagtggcatcccccctttataagcacagactcttagcaaacattgggccttgatcagaaatctgtcttggcctcttttcttctttcacgttctctcccttacagctccggcctcccactcaggaatctagtttgtgtggccacaggcggctacaggttttgagtactgagttgctacattgtaatttaaattactatcatgaatgtacttatgctcacaacagcattcacgacacaaatgcattgtcttctttattgatgagaaaggaacacaaatgtaatagtataaatgaatttctaagaacatataagatgtgaactggtagttataaccaaagtgcactatctattgtgctatgtatagcatattacttcttgttgagcacatggtatagagaagcccacagagctctccaaagtgatactacagggacatttctgttcctgctgaataatacccctttaacaccaagacatgaagaaatcatttatcatgggctcaaagaagtagaaacataaacttcttcttaatcacttcttctaacatttacttcatgaatatgtggggccaggtgaccataagcatatcctatctttttgtaccatgtgtttgtgtgaagtagcattctcaacatgactggaatattcaaaattttcagctgaaaagcattgaggatgttgtatatattacagtgctgaatattaaggatagctgtcattcttactataaaaagaagcaagcaattgaatctcattagcatgcagaattgtctttgtgttaaataaatagtaaaattacatttataaaaaagagcaagccagtcaatcctttggcatggagtgcagagaggctcacatctttaatggaggagctattgacagctggtgacttcatagggaggaagacgccattcttgaaggctgtggcttctaagtagttcagcctccctccagtggacggtcccacacttctgggaagactgaattggattaataaagttattaaaaagattcaatgcaatatagaacaggatactaaatttaggaggagtgaagaggtagaaacagatctgggagggccttatagaggagagagggttgaatatgatcaaaatatgatataggaaatcctcaaaaaatgaaatatcatcttaaaaattaaatatataaaaaatagagtctaagatatacttgtactttctacttctttagtcatgactgtatctcataggaatatatgagaagaaaatttaaagacatgctgaaaatgcctagaataaaaaaggatactctcttgaataacagagatttttcagatgattatttataggtacctttttttaaattttttttttgagaaaactggaagtcatggatgctcaatttgccttataagcctttggccaactggcaaattttattaaggagactgagcatgcattaagttccatcactaatttttgtcctaaaactgacttcccattcattgacattaacttaaagcctcattatcttcaaaccatataaatctacccacccagtgcacacctctgtgacattttacctctggtcaggtccaaagatcttaataagccaagagaggcagcatgttgtgttgttacaataggaatactcgacctaagacaaaatattactagaccctctatttgcacagtctgacaatagaataacctcatgtcttactagtatatattttactccatatactaacagcttcaaaaatagctttgtgtttcatctcattagtctcatcttcagtgagtatggaagaacccaataccagtcctatagacattcttgtcaggacagtgctctcagctgttgttcaaaagtcagctggcattgttcctctcaggctaatcttagacacttcacattatctcgtgaaattctaggaagaagagaacttgaatagagagtgaaaatgaccagggctccctgggactaaaccaccaatcaaagaaaacacatggaaggatttgtggctttagctgcatatgtaatggaggatggcctagtcggacatcaatgggaggagaggcccttggtcctgtgaaggttctatgtcccagtataggggaatgctagggccaggaaacaggagtgggctggttggggagcaggggggagaggataggggattttaggaggggaaactaggaaaggggataacatttgaaatgtaaataaaaaaatatctaattaaaaaacaaaacaaaaagaaaatggctaaataggaatgctggatagagaagtttcctgtacaatgagttatatttaagtatctcctgaaaagttgtatttggagacctcaatattgttttacaatattatgaatctgcttaagttagaaattcaaatgatagtggaaattgtaaagccacctgtggattaagtattcaaatacagcctgggagagacatccagcattcaaaccctaatcctcactttctccattttgtaaaatgtgagatagaaattttgaggggagaagtagattcctcaaggccacacaaatagaaaggcctagaaccatacttgggttcaagggtaattttaaagtttttgtaatcctatcctcttcccttgcctgtggctcttgcttaaaacacaagctatattattattctgtgttttacaacttgaagaagccaagcaaattgctcaagcttacagaggaagtaggtaatatttctaggataagcagtccctgcccttttcctttcttttttcttttcttctttctttccttcctcctttccttacttctttcttttcttccttcattttgagtcaggattttactatataactatgctatcatggaacatactatgtagatcacgattgactggtactcacagagatctgcctgtccctgcctcgtgaggtcttagactaaagttgtgacctccttcactctatatccaactaaaacgctgaccattgatggcttagtttaactagaaattgccttgaaatcattgcagacattcactggtaccctgtttccttatctgacctgctttaactgggtaagcttatgaaaagtcttgtgtagaagagaaagggagaacagcctgtgctaaatgaggaagctgccttgcctgttcctgctcagtggggtttctggctatactacatcaactgagtcagtgcatcttgactagttcccacacctttctctgaacagagagagtaaagggctcaataagaaaaatacagtttatggtctgtacgttgtattacatgtcatcccttactttctaaaaggcatcttcactgagaaagacatggatttctaaccttacaatctctacaaagttcagaatatataataatcttgaattatgattaactgttaattttgaccaggtcttctggcagacaggtcacatgtgttagtatcacttattcctcaagtgttgatgttagtatcagcatattaccgatgttccacaaacatttcctgaatgactgttaagcttcctacacattaacgagcctctgcattttttccagcttccatctatgatttaagtaaactctagttttccacttcttcatattctctctctagatctcaattattgcagtaccactgtccaagggcagaggaggttagctgggcccaggcggagtcagttctccactccccaccctgtgggtgtgttcagccttgtgagccagcatctagcttgagcacagcagtgctgagtcatgctgagtcatgctgaggcttagggtgtgtggccagatgttttcagctgtgactgatcagtgctatctgggtctctaggaggaagtccacagggaaggtgaaaagaaaataagtttgctacctgaagaaaacattacttacaccagcattacaatgaaaaggggaccctgccttgctgtgtgacataacctagaatattttattttctagttaaaaattacttctcatgatctttattagatgttataacaaatcattttttataaatgtaaagtttatttagactcatacctagaagcaacagaatcacacattttagtacacacacacacacacacacacacacaagagttttgttcataaactatgcaattgttaatgaaatgctatttggaatgggcttgaattcattgcagacattcactggtaccctgtttccttatctgacctgctttaactgggtaagcttatgaaaagtctggtgtagaagaggaagggggaatagcctgtgttgttagagttagggtcattggatctgtactaggtagttccctggcaagttcacatttaccctgtaatctagcacagaaccttagtttaggttagaatcagtattgtaaattctggttaagtgaattctaccattctcacatcattgtgaacatgagaggtactcatcagggatgtaggaattaccccagaaagacaggtgatattttggggtacaaatgcgcatttggaggaagaaaaggaagcacctagccctccttagttactctacagccactgctttggaaccaaaggccttctctgcacagatgtgtttcctctggttgttctgtcatcagagtttcctctcttcaaagaaaaaataaacttcttccagccaaaaagccatggcttttaagccactagttaccatccatgagagatattgcctgatattgttttgacagttctaatatgtagaaatgttccaaagatgatttttaatttctctaatttccaatctagtagaacttccaaggtatttcttaggtcatgattataataaccacaggtatagatagaggttagcacaaatttactgcttattgagcctcaaaattcttatactaatacatgctccagtttagaaattagcatgcattagtgggagcatgagtgtgcgcaatcatggcaggcatcctgcaaaggaatagattatgagactagcattgtgccaacagctcagttattacttttattcatttcctttagggaaaggagagtcatggtctggagaaagcatgttaggtccaaaatgtctctagggtagccaatagggaactgttcttttctacagttttctattaggccagttccttaattactaactttttaattacatatcagactcaacagttaaaaaccccttgctctgaagccttttagttgctttataatattttgagcccctcctttgatcttttgggttgtttgttttcctttttgaaaaattgcatctcagttgtattttgagaatgtgatttatttatttccttggctctgtagacttcataaattatattgccatggtacacttgaaaattttggtaatagcctcacatttattacaatatctgtacacttttatatgtattacatgaaacgtatttatcaggctttcctaagccagatcctcaaacactctcccataacacatacctcttatctactcatgaaggagcaatgatgggacaaagaaggcaggagcccaaacacactggcttcccccaatctcacggaggcctcaaccttgactcagctctgtgcagctctggctcttatctgtcaccacagtctgtgaccccacccagctgacactaccccaagtcccagaagaagaaaaacaccagttctttctacttctacttatttaaataaaataaaagaaagccttacacccctggacagataaacaagaataaaagaaagaagaaagaaaagaagaaaaaagaagaacatggaggaagaaaattggtccagtcagaaattgtaacaaaggcttgagtgaggcaggattattgagaattggtctcttggcaccttggtctaggatcctgaaaaaggaaagcttcttccgtttatagatgccttagactcactgaactagaggctcagatgacttactttcagaatggctttttcgtgttatgaattttggggcaagaacaatcactaaatattaccaacttcagggacaaagagcacagggtctcagtttctcacaatgtcactgggaatgaccttgctaaaggatggagtctggccattgtcagggtagttattatttaatctcttcttacttggccaatcctcatatcttttcccacagagatgtgagtttacagttcaggaaattccctaagttataacttccacctaggacactaaatgctgaagaggtatgcctagctaaaatatagcatttttactttttttttttataaatttcaaatattaccaaatcaaaaattgccaaattcaggcaaaagataccgtcaataagacaaaaagaccaccagcagattgggaaaggatctttacctaccctaaatcagataggggactaatgtccaatatatataaagaacgcaagaaggtggactccagaaaatcaaataaccccattaaaaatggggctcagaactgaacaaagaattctcacctgaggaatagcagagaagcacctgaaaaaatgttcaacatccttatttttttattacgtattttcctcaattacatttccaatgctatcccaaaatcccccaaaccctccccccccacactcccctacccacccattcccattttttggccctggtgttcccctgtactggggcatataaagtttgcctgtccaatgggcatctctttccagtgatagcccactaacatccttaatcatcagggaaatgcaaatcaaaacaaccctgagattccatctcacaccagtcagaatggctaagattaaaaattcaggtgacagcagatgctggcgaggattcggagaaagaggaacactcctccattgttggtgggattgcaagcttgtacaaccacgctggaaatcagtctggcggttccttagaaaactggacatagtactaccagaggatccaggaatacctctcctgggcatatatccagaagatgttccaaccggtaagaaggacacatgctccactatgttcatagcagccttatttataatagccagaagctggaaagaacccagatgcccctcaacagaggaatgattacagaaaatgtggtacatttacacaatggagtactactcagctattaaaaagaatgaatttatgaaattcctaggcaaatggatggacctggaaggcatcattcggagtgaggtagcacaatcacaaaggaactcacacaatatgtactcactgataagtggatattagcccaaaacttaggatacctaagatataagatacaatttgctaaacgcatgaaactcaacaagaatgaagaccaaagtgtggacactgtgcaccttcttagaattgggaacaaaacacccatggaaagaattacagagacaaagtttggagctgtgacaaaaggatgtaccatctagagactgccatatccagggatccaccccataattagcttccaaacgctgacaccattgcatacactagcaagattttgctgaaaagacccagatatagctgtctcatgtgagactacgccggagcctagcaaacacagaagtggatgctcacagtgagctattggatggatcgcagggctcccaatggaggagctagagaaagtacccaaggagctaaagggatcttcaaccctataggtggaacaacattatgaactaaccagtacccctgagctcttgcctctagctgcatatgtatcaaaagatggcctagtcggccatcactggaaagagaggccccttggacacacaaactttatatgccccagtacaggggaacgccagggccaaaaaatgggaatgggtgggtagggaagtgggggggggagggtatgggggacttttgggatagcattggaaatgtaattgaggaaaatacgtaataaaaattttaaataaataaataaataaataaataaataaataaataaataaaatcaaagtgaaaaaataattgccaaattcactttgcacgctagaagtatggatggaccctaatctcacaataaaacccttttgaaaatcatattcagccatagaattcttatatctgcacatcagtatggcttttgaggcaacacttttttagacattattcaaatatttaattagtgcatacttaagaagggctacattttaataaagttcaccagttattagttaatgtaattagctagctaaaacaaagaattttggctattccctaaggtataaattgaagcagtataaaatgaaggggaatattgaaaatataaagtacctacctaataaaagggcctatgtgttttattatgtcagagtttttggtgagttgatcttgatttataaaatacacaggtgagcttatttaacataaaaagataagagttctctagaattttaatcctgaaaatagacaatttatttactctaggacccaagttaaaaaagaatgccatggagatgataaatagatcatagggtaagctattataggatattgtaaaaatgcagaaacttgttttacctagaaggtatgagagctttctgccaatgaaaaagtaaaaatagggttaataaacagtctggcttgttttgtttgaatttagataatgacaataaattatagcttaacaaaaatggagtagtcttagaccagtgactcatctgtttccttctgatcaagtacccaagtagcctgccttagatgggaatataaatatatatatatttgctgctttggagaacctgtttaaatgttttacacttctacacatcaatgtagcaataatgttaacattttaaaagcattttaaaaaatgccaaagaaaccaagaaagagaagtgatgttatgggagaaaatagggcacttatgactttgttccaggttaccagtttcaagagaatacctggctgactatggttttctattttctcttcctagtaaaaactctcgtgataattaagtgccagacacttctctggtttttcagtatagccccagaggtcagtcaaacaggtgtctgctctgaactgaaaagggagggatttctagctaagaaagacatggctctctctttaactcatcttcaaatcatgaggctgatgcattcagtgtctttgacattttccattgcatgttccttgaaggtttagggcttcctgcagggattccaccttgctgtcattagtatgtagtcattcctagttaatgcaacacctaagaaacttactctatctaatttattgctgttctgggaatatgaatggagacataaaatggaagcagagtagtgaccatttcttttaataaaattacaaaacatgtttttcctgttcagaaacttcactcacaatttttctaatttaaaactatttatgatgaagaacaactgtagagactatttttttcttgtttaacactgaaaaacttgtgtttaagggcctaatttactacaaacagtatacttcaaaaatttctatactaataacatctaaaattagcacagcattgaattctttcttttaaaaagattgtagcagccataggaattgaatccattcccagagctttgtacatgctaggcaaacactcagacttggggttttgaaacaaggatgcactcaagctgacagccagctgattttgtctattcagtcttaaacttgaacaatcaaaacatctttctcaccctagagttacattttcctaggctgtctattataggcaagaaaactttaaactgaacccacagaacattttttaaaatgttatgctctagttgtaacagatatgcttactttcagtctgtatgacatggataccatggtcatcctgttagcttaatgtgttcataagaaggtgcatcacaccaaacgtagctattttaacatgtataaagtatccatattctagtcaatcctatgtatatacattatttagtaggtaatagtctgccaaatagtctatgccatgagaagataagttcacatctatactggccatgggttagaatctgtactcaaaagataatgtagagaaaaagctgacagagggccagagattcaattacttgtaataatgccaatttggggacactttaaacaagataatgcttctgtaagcatagaagaaagtaaaacaaaggtgttctcatatgtcagaaatggctgttagacacataacaaatcatcataaaagccagggcaagccaaaggttatagagaagatcctctgggtaaatttggaacacaaagatttgagacaccgaagccacattgctaaatgaaaaataggcactatcacttgggccccacaagaaaaacaaacaaatgtaaaaaataaaacagaactaaactaaataaaatgaaagtcttggaagagaaactcttaggggggttaggagcacaagaagccatagaggaggtaaaaggaagaaatgcaggcagaactgaccagaggcaggttggaggacaactttcctataaataggaaagccaaactgtgaccaaatctggagccttcctcccttggtcaacagttctctcaccttacagttatatcacttttgtgattctgtttatttgaataaaaggtggataatgataactgtcttgccagatgcagattaaataggatggtgtaaaactatccttcatgcacatggatgcagttaaacacatacaaatgtaggcttttaatttcaggtccaatacgtaggagatagctaataattccaagaagagattagaaatcaagcacactagccatcctttagttataataaacactatccacaaatgtttctcaaggatattgatgaatcaactcactcattcctcagttgaatcacaagcctagtttaaagttatttcagttccacctcacagatgagaaatatctatatgggattaagcaaggaaaaagatcaaagcaatattactaacggagtaaggttcacaaaggtttggtcagagaactctctagaatcacaaaacaagaacttgttatatccatcttctctacactgtcacttcctgttgttgtattttggaattgagtcttcggacccattgtcaatcctttgctactgtattcatcctccagatgcaactatgtataagtcttgtctacttggggcaatatatatctaggagatagagttataaagcacatatcccaagaaaaggagaaacagatgtaatattggcatttctgtgtccacagcacaaattccttttttcatgagtttgttcttattattatagccattctttccctaaacggtaaagttattttagactggattttttttcctatagtgggctaaactcctctttctgtgcctttgttggaaaaagtgataagagaaatgggcgttatactgggagtttacatgtggagagtagaaaatgaaaagagaataagcaaaacaaagagagtttttgttgaaggaggagccaaaaaagaaagaatacctccatatctaatgtgcattatcataaacacagtgtacagtttttgctgaccctcccatgacctggctccacccatgaggaccacgggtcaggctgaccaatagcttcaaagaataatgcagaacaaagggtcagaacattgtctgtgaagcataaaaggccaccacttctagcagcagtacatacttgcttctgacactcctgtgatcaccagcaacctcccagacttgccatcatggtgaactttactgctgaggaaaagaccctcatcaatggcctgtggagtaaggtcaatgttgaagaggttggtggtgaagccttgggaaggtaagaattgtttttagggtacaaagagctagggaaatcaagaattctgaggctcccttatatttctacttgtctttctccacttcacaggcttcttgttgtgtacccatggacccatagattttttgacagctttgggaacttgtcctctgcttctgccataatgggcaacccaagggtcaaagcccatggcaagaaggtgctgactgcttttggagagtccattaagaatctagacaacctcaagtctgccttggccaagctcagtgaactgcactgtgacaagctacatgtggatcctgagaacttcaaagtgagtctagggcaatgccacaaatttattttggatttgtctcggggacaaaatgagaagccaagaatatgaataagggggtgcttacttagctgtcaaagttaattaattggtcccagtagggtgacagtgaatggctgtaagaaacctaaattagtttacaaacatttagaaaattttgtcgtgataaaattttcttggatttatcatggagagtaatatgaaaagtagtagatctatgcaagaagaaatggaatagggagtggaaaaatcttaactttttgtgggtcctattgattgatgttgaagaaaagtcttgcaagacaaccttatggtgaattttctcaataaacataaaattgtattaaatttccaggtgaatatcttgacaaatggaggcttgttcttacattgggggtagttttaaaactccaccaacagcagtaggaaaacacaaattctgaatttacagatactagacaactgtagaatgagaataacgacaggcaaataaatatgctgagaatagaaggtatgagaatccaggcagaacagtggtgagtgggaaaaaaagaggaacaatagaaaaatggaatctctgctcatcagagatgattgaggaagctttgatgctgaatgtgttaaagagtatgggttcaaaatatttctttgtttttttaatgcttattcgtttcaaatcttcatttaacacaccgatttgtttcttttgtctttccatcaacagctcttgggtaatgtgctggtgattgttttggctagtcacttcggcaatgaattcacagctgagatgcaggctgcctggcagaagctggtggctggggtggccactgcgctgtcccacaagtaccactgagccctctctctagctgtccagcaatcctgtgtgtccgctatgcctcctttctgcacatgaatactggactgttccttgaaagcacatcatgtttaataaagatcatccttcctggtaatcaaaaattcagttttgtcttgtctgctttctacttttatgctaaagacacatatttgatgtgtttttggaaagggggaagcacaggaagactcaggcatttatctgaaacctgcagggactcaagagagaaacgtagaagccatggaaggcttctacaggcccagtgagagtctaaagctgagaaagaattctcagagagaagaaagaaatttagtggagaaggcattgtgtatggaacatatgaacatttactgtagagggtgaagaaaagggtgacaagtgataccttgcagcaggttgtgacatcccattaccattaggaaaaagcttttacaagatccaagagctaatttagaattaactttctttaaaaaagcatttgttgggtaaccaattggtgtgctctgccccggggaagactcttgatccagctctcagcaacccttagttgactgtaattctttgtgtatggttgaggtctcatgggctttatttaccccacccatattagcaaatgtgtatcacagcaagcttcatggtcttttggctcttacaatcttttgcccttcttctgaagtgttccctgatccttaggtgtgtagatgtatccactgaggttaggctccacaactctgaagtttgaatggttgtggatttctgtactggtctttgtctattgcaaagagtgttctacatgagaggagaagactacaacttatacatatacacacacacacacacacatacatacaattacaatggcaaaatgacacgattttgaaacatggggagggggcaacattggagatgtaaagtgaattaattagtggggaaaaaagaaaataaaaaagtaaaaaaaaaatcataataaaagtaaattattttttaaaataattaaaattaaaatttgcaactgttcagaaaagtttttcagacagacatttggtgtctcggtatgtaagtcagttgatgaaatgaatctctggggtatatgaatcctgagactggagcactaccaaaaagacacaaagtagcagacttatagagttggttatagaatcctcctcacttttgtgttttattttagaaggtagcagatacatgtaagtagactagcccttgaaattgacattttgttctagggaaggagaaataccctatttatgtggattctaatgactaacccttcagcaaaaatacgagagaaaacttgacagatgtttctcattggtttgatgaacttcctaaaaaatattacaatcccaatgagtaatatcataagtagtccctgcttccttcattataggaaactctagtaaatacatggtaatcctgtatttgtagaagccaggccattgttgaatgagaaaaggggcaagaaacaaaagtggcagactgaggaaaagtaaggaacaagtagagaaggaccgaatggggtcgaggagggcccttgagcaatgagattgaaccagcatcctcattagagtggacagactgctggggagtcctcaaggagactaacttacaaatgctgtttgtcctgtaaattcttttctttatttccttttctcatttttgtatatctttttgtgtttccttccatagctcctgggtaacatgctggtgattgttctttcttcttactttggcaaggaattcacagctgaggtgcaggctgcctggcagaagttggtggttggggtggccactgctctgtcccacaagtaccactgagccctttccctgatgtccagcattctgtacacccctcagctctgccatacccatggccactgtgctggtctctgaaagcagggcttctgcttaataaagtccattcttttcagtaacccatgagtcatattttgttgtgtctgtttcttacttttgtgtttaaagaaagaaggctgatgggcagatggtaagggagcgagacagaaggacgcttgagtttcttttagaactttgctggaattcaggagaggaaagtagatgttacagaatttttctagagccccaggaaagatgagaagttggggataattctcatgtaggaaagcaaagggttaatgccgtggagaaaaaagttctgtggtagtcactaaaacttagtgtagagggtgaagaaatgcatgacaaatgatcacctacagtctgtgttatgtgccatttaattaagttaaactttagacagatctaatgctcaacctgagataatcagtttaattattttaaaaaataatttacttttattatgattttttttacttttttattttcttttttccccactaattaattcactttacatctccaatgttgccccctccccatcccccctcacacaatttcttctcacatcctgcctcttctcctctgaaagggttgatcccctcctagggtatccccgcccacacacacacaaccctggcatatcaactctcttcctgactaggcacatcttttcccactgaggtcagacaaggccatccacttaggggaattgattctacagacagtgaacagctttagagacagacaggcttatattttccagttgttgggggaaccacaagaagattgagctacacatctgctacatatgtgctgggacctaggttcagcgtgtataagctctttgattggtggtacagtctctgagaccccctaacagtccaggttagttactctgttggtctttctgtggagttcctattcccttagagtccctctatcttacataagagtcccaagctgcattcaatgttggcattcgtttccaggaggggttcaggtttaagtgtgggaggagacaggagagggggccaaagggcctggagaatgaatggaaatctgcagttggcaatgttgtaggtatgggggaacattacaagaatgtgccataaacctgagatgggggaggctcctgagggttcatgggggaggtaaccttatctgagactcatagcagtgggggtatggaatctgaaaagtccacctacagtagccagactggaagtccagtggaggaataaggacactaacccatccacaaaacatttgaccccaatttgttctgtctacaagaaatgtagaaacagagagggaacaggaattgagggaatggccaaccaataacaggcccaactgtagaaccatcccatggacaagcactactccttgaccccatactcacttatgcttgcagacaggagcctagcatcaccatcttcctagaggttccacacagcagctgacttaaaaaaaaaagatttatttctcttaatcaagtatctctgcatttatctgtgtttgggtttgtgcacgtgagtataggagactataggcatcaagttccactagagctggagttacagatggttgcgagctgtatatgctgagaattcaggtgctctgaggaaagtatttgctctcaaacacggagtcatcatctctcccacgctaaatgaacattctccaacagatactatatcagatgtcctctggaactgatgaaagaaaagggacaagttgatagaaagcattaaatatataagaaaaagtttcaatgaaaccaccacttcagacttgttttttgaaggcattccttgtctcaaggaggaatgaaagctaagagatgcgaccactgtgcttttctgtgctactgtaataagcaatatgattatgatagggaaagaatataaatggaatcttctccagacaggtgggcatgataatttcatacacaggacatctacaaaaatgccaaaaagttctgtcatttaaggtcactgaactagatcttgatgatttgtataaaactagaagatgctgaagagataaaatactggcaaaagtagacaatagggatcttaattataaaaatctcaatattaatactttattaagcattaaacaataacacttacctggtgaaatatgcttatcactccactacttgaaaggctaagcaaagtgtcacagtttcaagagttacctgagcaacagattgagttcaaggacaaccaaagaactcaatgagttgctacctcagaatgaataataaaaacctggtctgagggtgctgctcagagcagagcactgtcctaacatgtggactgctagggaatcaagatccactagcactaaacaaaagacaccaactgaattgattagtaaagaataagcagtctcaggatttctgactcaagaaatggtattactaagaaaaatattcttaaggatccaatttaacttaaatgcttaggaaccattacagagatataaaagtttaaaatgaagaggtgaagcaaggcatgcaacctgaggtaatgttcaaaggtgggatgggggagacagtgtcagattaactctaatatatgagaagaaaacagaagatagtagaagatgaaatcacaaatactgagtggacataactacataaagtgtacattgacttggaaaactcatgtggataaaacacacttgagagaatttaaaggtgctcaaagaaattcaagccctagtcaatctcttgtcaaggctggtgatctttaagtggtagaggtaagataaccacattttagctactaaactatattccctcatcctgattccatagattggttagagtatgactggtggattgtatttcaagttgtctttgtccactttaaatatgaaagaacaatgattcttgtagttttaggctatcaacaacattggcctttttggtctacagcatttcaatatggcaattaacaggaaaacaaaccaaaccaaacaaacaatagcaacaaaaatgcaggcgttgtatatgacactcgttttctctggacctgtcaagagatgagacaatgcccattttttataaatttacttttctccttatgccatcatgaatattttggctctagaaatcagcggataaaagatggcaattatgcagtggtgggaggaaagtatatttgccaaatgtttcagggctatatatacctataaccactccaatggaaaaaaagagataactgaaaaatagttcttcatatgtgcacacacacattcacatatacaggtaggatgataaaagacttttgcttgttttatttctcaagacaaggtcctcttctgtagcttcgatggcttagaacttaatatgtagactgtgtgctagcctcaagctcacagagatgtgtctgcctccttcttctgagtgctgggattaaaggcatgtgctattctgtgcagcctatgatagtcaatatacatttgcaataaaaattatttgagagaagtactatgaccctagaatagtagtgcataagaaatgagtagtattcaaaggttatgtcattatagtttctcattcctattaaggaagatggattcctctgttagattatgagcactgcagcaacacacccaccatgttccactttattatttttatatttagtgatcatggatattatcagcttcactgtcacagaaatatttattttctcttccttcagaacactgaatttgctattacaacattttccagtatctttctgtgacatgttacttctagacattctggacacaacaaacttaactcttcattatgtagagaaactgaattccataccaccatgtcctgtccttgttaatcccaattgttaattttcttcctagtaataacatattaaaatcttttttgtttgatatacttactcatttctgtatcttctatctcctagtgaatgaggctagagaaaagttctgtcttgtctctcattcattataaatcccaggacttgtgaaggataattctacagagaggcagcaggaatgggtgggtgggtgaatgaacaccctcatagcagggggaggggagataggataggagggcttggggggatgggaaaggggataacaattgaaatgtaaatttaaaaaatcaataaaagagaaacaaaagatcccaggactaataataataattatcacatagttatgagacaaataatgattgagtgaacatttgagattacatgaattagctgtcataaagaaacggtttcaaaatcctggactaacatgacatggggattatggagggtctattaatagacatgaactaattaatacaactttgtaggaaattcccccaagactctgctgaagagcaacttagggttactggttaagatatttggaagcttaaactcaggactaccaactatcctccaagattaaatcatggagatagaagctaaaggaatatatatgtacatatttgccatctcacgaatgacttccttttaaaagatcatagctctagaaggtaccagagatcggggagctgagaaactttcaggattcaaagggagggacctaagatgaaatgccctataatgagaagagggaacttgtagagtccacctccagtggaaagacagggcatcaagtgtagggatggtgttgccatcccacagtcataaactctgacccaatactgaaggataattctacagagaggcagcaggaatgggtgggtgggacgaatggagaagagcctgaggaaaaaaaggttcagtgactggccctatttagaatccagttcatggggaggctccaaggcatgacactattactgatattatggtgtgcttacagacaaagtctagcatggctgtccaacatgaagctgagtcagatgcagatacatacacctaaccaatggacagaagtcatggacccctgtggatgaactagggaaaagctggaagaagctgatgaggagggcaaccctatatgaagtttcaactgacctagactcctgagatctctcacacactgagccaccaaccaggcagcatacaccagctgatatgaggtcactgacacagatacagcagaggactgccttgtctggcctcagtgagagaagatgcacctaacctttgagagacttgaggtcccagggagtggggaggtctggtgtagtgggagtggggaggcatcttcttggagataggggaggaggtatgggatgaagaacaatcagaaggcagacggggagggagataacaattagactgtaaaaaaaaaagatttatcagtgaaaagaaagaaacagagggggggagggagagggggagggggaaggggaggggagggggagggggagaaagagggagagggagaaggagaaggagaaggagaaggagaaggagaaggagaaggagaaggagaaggagaaggagaagaagaagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaggaagaagaggagaacatagctggttcttgttaacattgcatgttctttacagccatgcaaataaaaatctctattgaccactacgttaaaatagctacaaaaccttaaaagctgtcagtagaaactcactgctagggatgaacttcataatgtataatccagtcctagctgtgatagtgcatgtgttactgcatggaaataccctgtctcttcacagttaggttacaaacacacaaaaagtgaaaacagagctgagttgaagaaacctgaaagcttgatcatttagtgttctcagtatttaaccagtaatgatcatagagaaggctaaaccctcacccttttcaccaggcagctacacttatcctgggtgggtgggtgggggctgccaattgtatggtgtcaacactgtgcattcaatgggtggaaaatgctgtcatgtacacagacttctctactttagtgtatgatggaatgtggagacatgttgtacttctacacagtaatacatatatatatatatatgtgtgtgtgtgtgtgtgttataaatatgtgtgtgtgtgtgtgtgtgtatatatatatatttttacttagaaactgaaatgtattaggaatggctttcctggggctgtgggaaataagaagatcatgtcctaagcctactgaaaatgcattcaatggttttgcacaccacatctttcttatacgtggcttgtgagtaagactcatatttctatcacttaggttcgtaaccccattcctaaaaatagcctctggctcactgaggcgttcccatgtttgcctatgcttcaacttaaatgtattaatccctctaagtctgaagtgaaaaagggaagaatgtgaaagacacccttgcaaatctcctgttgggggaaggagctaaagagaaggaaagaaggaaagaaagacggtgaactctgggaaagctgcagcaggaggctctgtctctccgaggcagggggcctactggacactatcttagtgcattgctatctagaacttaccccactggaccccacccctgtcttgcccagactctcttgaccaatagcctcagagtcctggggaggggtaaggggagcaaggtccagggtgaagaataaaaggacaggtcttcagcctcttgaatacacttgcttttgcacacttgagatcatctccaagcttctatacctcacaccatggttcacttcacagctgaggagaaggcagctatcacaagcatctgggataaagtggacttggaaaaagttggaggagaaactctgggaaggtaaggaatggagggaaattgtccttgtgcatggcagaaatttccagggtttctatagggttttgtggcacactaacttttaactgctaatgccctatgtcttaggctcctgattgtttacccatggactcagagattctttgacaagtttggaaacctctcttctgccctggccatcatgggaaacccccggattagagcccatggcaagaaagtgctgacatccttgggcttgggggttaagaacatggacaacctcaaggagacctttgctcatctcagtgagctgcactgtgacaagcttcatgtggatcctgagaacttcaaggtcagttctgagcatgctcatgtgttcattatggattttactagggacaatacttggagttgagactgtgcttggcaatgccttgacagaggttagagtccatgggtccagaattcttgtcagtaaccgttgtagaaatcttaatatttagctgtgcatatgttctgggcaacaatgatttgggtgcagatttgagtgagctcccagcatttctggggccttgggtttgattctgagcattggaaactaagcattcaaatattggaattttttaaaaaaggagtatgtttttataaattaatacatctatgcaagaagaaactgaatttaagttaatatcttatcatttgaaaggaaaaataccttaattaattgtgtcaatcttaatgtccaatcctttatggaagactcgaggaggaaatcaaaatatagggtttttttttcttattattttgacaactttctaaatgttttactttcccactgagcattggcacagtttgagccttctctttggttgaacactcaaatctactaagaatcttgtatcgcagtcatgtgttgatttagatttgaccattgatgaatgagacagggagcaaaaaatgggaggagataaaaagggcagaatgaggaaaggtacagatatagccagttgagtggtgtacaagaggagtcatgtaattcagttgtcaaatgcataacaggagaagtgataggtagtgagggactggaatcctcaaggaacgtaacttttacacgtcacagatttgaaactactgatcattcctatgtgcctttttgttacagctcctgggcaacatgttggtgattgtcctttctactcattttgccaaggaattcaccccagaggtgcaggctgcctggcagaagctggtgattggagtggccaatgctctgtcccacaagtaccattaaactccattccagtacactggcaatcccatgtgtctatgatgccctctttgagtccatggggactgcattgagagcacaaattttgtttaataaaattgattcttaataacattgactttttgttttttttttgtttgtttttacttttatgttgaagaaagatctcaatgggcttgttggtgggaaaagacagaagaagaaaccagatagagtgaagtattagggaaagagctaagttaaagatgagaaagttttctccaggaagagatgaaagggtctgttcagtataagatagggtacaaaatatttactgtgcaaggtaaaaagtagggttgcaggtgccaggaggtaaagaagactggtgagatgtgctatttcttttttaagtttcactttttgcatatgagtgagtgtttttcctgcataaacatgtgtgtgtcctacctgtgtgtggtgctcctgcaagccacaatatagaattacatcctctggaacttgagttacagccaattgtgaactgtcaagtaggtactgggagctgaagtctggtcttttgaaagagctatttaccactgagctccctctctagcccaagatctgctagagatttttaagagaatactttaaaatatgaacaaaaagtattgtttttgattagttatatttctgaaagagctatcttacatcttgtgagactgagacattaaagaaaaggggggaattgagtgaaagttgggaacattcctgaaaaaaaattacaggagctactgtacctatactttctttaggtatttgtaaaggttattccactggcacagtgagaaataaaggctatagcatctagtggtccagatcttgtaatggggtgtaacatgggcttacatgaaattagcttacatctagctacttcagaagatacacatttctagagacaaagaggaactagagtcaacttgataagaatttcatcccacattccactccatcaaactgaatcatagaaaaggatgagaccgcgtgtagctggtggctgtatgaacaaggaataggtgaacccgatgggagataaacagagggattaatgtttctgcatcaaaacacagaatttaggagagccaacactacagccagctagtgtaaactggagagtgtggatatatctttcattcacaagccaaataatttcttcatatcttaaggtaacttgctcatagggtagggagggcaggagtctgggctgggcataaagggaagagcagggcccgctgtgcctgcacttacttctggcacagatgtgtttactagcaacctcagctgaaacactatggtggagctcactgcagaggagaaggcagccatcactgccacgtggactaaggtgaaggcagaagaacttggtgttgagtccctggaaaggtcagtatccgacagcctaagggagcaagtggaaggaggtatgtggaggcactgaatttctctgtcctcatgcttcacttgctagaatactgacggtttatccacacaccaagagatactttgaccactttggagacttctccttctgtgctgccactgaagataaccacaagctgaaggctcttggtaagaagatgatagaatcctttagtgaggacctgcaatccctggacaacctgcactacacctttgccagcctgagtgagctgcaccatgacaagcttcatatggatcctgagaacttcaaggtgagttggctagatgtgctgccttctgctcacgctcttgatttctacttactgctgcatcccccaccttctctttcatttgcctacacttaatcgtctaatgattttcaacttttgttcaatatccttcttaatttacccctttcacaatcttcaattaaagaaatgtatttattttatatcctgtcttttgtgctccacccacagctctacctacatttatcctcaagtcccttgcttagaccacaagtcaaatgacacattctgtttttca

SEQ ID NO: 16 - DNA, 25454 bp, Mus musculus
tgaaaaacagaatgtgtcatttgacttgtggtctaagcaagggacttgaggataaatgtaggtagagctgtgggtggagcacaaaagacaggatataaaataaatacatttctttaattgaagattgtgaaaggggtaaattaagaaggatattgaacaaaagttgaaaatcattagacgattaagtgtaggcaaatgaaagagaaggtgggggatgcagcagtaagtagaaatcaagagcgtgagcagaaggcagcacatctagccaactcaccttgaagttctcaggatccatatgaagcttgtcatggtgcagctcactcaggctggcaaaggtgtagtgcaggttgtccagggattgcaggtcctcactaaaggattctatcatcttcttaccaagagccttcagcttgtggttatcttcagtggcagcacagaaggagaagtctccaaagtggtcaaagtatctcttggtgtgtggataaaccgtcagtattctagcaagtgaagcatgaggacagagaaattcagtgcctccacatacctccttccacttgctcccttaggctgtcggatactgacctttccagggactcaacaccaagttcttctgccttcaccttagtccacgtggcagtgatggctgccttctcctctgcagtgagctccaccatagtgtttcagctgaggttgctagtaaacacatctgtgccagaagtaagtgcaggcacagcgggccctgctcttccctttatgcccagcccagactcctgccctccctaccctatgagcaagttaccttaagatatgaagaaattatttggcttgtgaatgaaagatatatccacactctccagtttacactagctggctgtagtgttggctctcctaaattctgtgttttgatgcagaaacattaatccctctgtttatctcccatcgggttcacctattccttgttcatacagccaccagctacacgcggtctcatccttttctatgattcagtttgatggagtggaatgtgggatgaaattcttatcaagttgactctagttcctctttgtctctagaaatgtgtatcttctgaagtagctagatgtaagctaatttcatgtaagcccatgttacaccccattacaagatctggaccactagatgctatagcctttatttctcactgtgccagtggaataacctttacaaatacctaaagaaagtataggtacagtagctcctgtaattttttttcaggaatgttcccaactttcactcaattccccccttttctttaatgtctcagtctcacaagatgtaagatagctctttcagaaatataactaatcaaaaacaatactttttgttcatattttaaagtattctcttaaaaatctctagcagatcttgggctagagagggagctcagtggtaaatagctctttcaaaagaccagacttcagctcccagtacctacttgacagttcacaattggctgtaactcaagttccagaggatgtaattctatattgtggcttgcaggagcaccacacacaggtaggacacacacatgtttatgcaggaaaaacactcactcatatgcaaaaagtgaaacttaaaaaagaaatagcacatctcaccagtcttctttacctcctggcacctgcaaccctactttttaccttgcacagtaaatattttgtaccctatcttatactgaacagaccctttcatctcttcctggagaaaactttctcatctttaacttagctctttccctaatacttcactctatctggtttcttcttctgtcttttcccaccaacaagcccattgagatctttcttcaacataaaagtaaaaacaaacaaaaaaaaaacaaaaagtcaatgttattaagaatcaattttattaaacaaaatttgtgctctcaatgcagtccccatggactcaaagagggcatcatagacacatgggattgccagtgtactggaatggagtttaatggtacttgtgggacagagcattggccactccaatcaccagcttctgccaggcagcctgcacctctggggtgaattccttggcaaaatgagtagaaaggacaatcaccaacatgttgcccaggagctgtaacaaaaaggcacataggaatgatcagtagtttcaaatctgtgacgtgtaaaagttacgttccttgaggattccagtccctcactacctatcacttctcctgttatgcatttgacaactgaattacatgactcctcttgtacaccactcaactggctatatctgtacctttcctcattctgccctttttatctcctcccattttttgctccctgtctcattcatcaatggtcaaatctaaatcaacacatgactgcgatacaagattcttagtagatttgagtgttcaaccaaagagaaggctcaaactgtgccaatgctcagtgggaaagtaaaacatttagaaagttgtcaaaataataagaaaaaaaaaccctatattttgatttcctcctcgagtcttccataaaggattggacattaagattgacacaattaattaaggtatttttcctttcaaatgataagatattaacttaaattcagtttcttcttgcatagatgtattaatttataaaaacatactccttttttaaaaaattccaatatttgaatgcttagtttccaatgctcagaatcaaacccaaggccccagaaatgctgggagctcactcaaatctgcacccaaatcattgttgcccagaacatatgcacagctaaatattaagatttctacaacggttactgacaagaattctggacccatggactctaacctctgtcaaggcattgccaagcacagtctcaactccaagtattgtccctagtaaaatccataatgaacacatgagcatgctcagaactgaccttgaagttctcaggatccacatgaagcttgtcacagtgcagctcactgagatgagcaaaggtctccttgaggttgtccatgttcttaacccccaagcccaaggatgtcagcactttcttgccatgggctctaatccgggggtttcccatgatggccagggcagaagagaggtttccaaacttgtcaaagaatctctgagtccatgggtaaacaatcaggagcctaagacatagggcattagcagttaaaagttagtgtgccacaaaaccctatagaaaccctggaaatttctgccatgcacaaggacaatttccctccattccttaccttcccagagtttctcctccaactttttccaagtccactttatcccagatgcttgtgatagctgccttctcctcagctgtgaagtgaaccatggtgtgaggtatagaagcttggagatgatctcaagtgtgcaaaagcaagtgtattcaagaggctgaagacctgtccttttattcttcaccctggaccttgctccccttacccctccccaggactctgaggctattggtcaagagagtctgggcaagacaggggtggggtccagtggggtaagttctagatagcaatgcactaagatagtgtccagtaggccccctgcctcggagagacagagcctcctgctgcagctttcccagagttcaccgtctttctttccttctttccttctctttagctccttcccccaacaggagatttgcaagggtgtctttcacattcttccctttttcacttcagacttagagggattaatacatttaagttgaagcataggcaaacatgggaacgcctcagtgagccagaggctatttttaggaatggggttacgaacctaagtgatagaaatatgagtcttactcacaagccacgtataagaaagatgtggtgtgcaaaaccattgaatgcattttcagtaggcttaggacatgatcttcttatttcccacagccccaggaaagccattcctaatacatttcagtttctaagtaaaaatatatatatatacacacacacacacacacacatatttataacacacacacacacacacatatatatatatatatgtattactgtgtagaagtacaacatgtctccacattccatcatacactaaagtagagaagtctgtgtacatgacagcattttccacccattgaatgcacagtgttgacaccatacaattggcagcccccacccacccacccaggataagtgtagctgcctggtgaaaagggtgagggtttagccttctctatgatcattactggttaaatactgagaacactaaatgatcaagctttcaggtttcttcaactcagctctgttttcactttttgtgtgtttgtaacctaactgtgaagagacagggtatttccatgcagtaacacatgcactatcacagctaggactggattatacattatgaagttcatccctagcagtgagtttctactgacagcttttaaggttttgtagctattttaacgtagtggtcaatagagatttttatttgcatggctgtaaagaacatgcaatgttaacaagaaccagctatgttctcctcttcttcctcttcttcttcttcttcttcttcttcttcttcttcttcttcttcttcttcttcttcttcttcttcttcttcttcttctccttctccttctccttctccttctccttctccttctccttctccttctccttctccttctccttctccttctccttctccttctccttctccttctccttctccttcttcttcttctccttctccttctccttctccttctccttctccttctccttctccttctccttctccttctccctctccctctttctccccctccccctcccctccccttccccctccccctctccctccccccctctgtttctttcttttcactgataaatcttttttttttacagtctaattgttatctccctccccgtctgccttctgattgttcttcatcccatacctcctcccctatctccaagaagatgcctccccactcccactacaccagacctccccactccctgggacctcaagtctctcaaaggttaggtgcatcttctctcactgaggccagacaaggcagtcctctgctgtatctgtgtcagtgacctcatatcagctggtgtatgctgcctggttggtggctcagtgtgtgagagatctcaggagtctaggtcagttgaaacttcatatagggttgccctcctcatcagcttcttccagcttttccctagttcatccacaggggtccatgacttctgtccattggttaggtgtatgtatctgcatctgactcagcttcatgttggacagccatgctagactttgtctgtaagcacaccataatatcagtaatagtgtcatgccttggagcctccccatgaactggattctaaatagggccagtcactgaacctttttttcctcaggctcttctccattcgtcccacccacccattcctgctgcctctctgtagaattatccttcagtattgggtcagagtttatgactgtgggatggcaacaccatccctacacttgatgccctgtctttccactggaggtggactctacaagttccctcttctcattatagggcatttcatcttaggtccctccctttgaatcctgaaagtttctcagctccccgatctctggtaccttctagagctatgatcttttaaaaggaagtcattcgtgagatggcaaatatgtacatatatattcctttagcttctatctccatgatttaatcttggaggatagttggtagtcctgagtttaagcttccaaatatcttaaccagtaaccctaagttgctcttcagcagagtcttgggggaatttcctacaaagttgtattaattagttcatgtctattaatagaccctccataatccccatgtcatgttagtccaggattttgaaaccgtttctttatgacagctaattcatgtaatctcaaatgttcactcaatcattatttgtctcataactatgtgataattattattattagtcctgggatcttttgtttctcttttattgattttttaaatttacatttcaattgttatcccctttcccatccccccaagccctcctatcctatctcccctccccctgctatgagggtgttcattcacccacccacccattcctgctgcctctctgtagaattatccttcacaagtcctgggatttataatgaatgagagacaagacagaacttttctctagcctcattcactaggagatagaagatacagaaatgagtaagtatatcaaacaaaaaagattttaatatgttattactaggaagaaaattaacaattgggattaacaaggacaggacatggtggtatggaattcagtttctctacataatgaagagttaagtttgttgtgtccagaatgtctagaagtaacatgtcacagaaagatactggaaaatgttgtaatagcaaattcagtgttctgaaggaagagaaaataaatatttctgtgacagtgaagctgataatatccatgatcactaaatataaaaataataaagtggaacatggtgggtgtgttgctgcagtgctcataatctaacagaggaatccatcttccttaataggaatgagaaactataatgacataacctttgaatactactcatttcttatgcactactattctagggtcatagtacttctctcaaataatttttattgcaaatgtatattgactatcataggctgcacagaatagcacatgcctttaatcccagcactcagaagaaggaggcagacacatctctgtgagcttgaggctagcacacagtctacatattaagttctaagccatcgaagctacagaagaggaccttgtcttgagaaataaaacaagcaaaagtcttttatcatcctacctgtatatgtgaatgtgtgtgtgcacatatgaagaactatttttcagttatctctttttttccattggagtggttataggtatatatagccctgaaacatttggcaaatatactttcctcccaccactgcataattgccatcttttatccgctgatttctagagccaaaatattcatgatggcataaggagaaaagtaaatttataaaaaatgggcattgtctcatctcttgacaggtccagagaaaacgagtgtcatatacaacgcctgcatttttgttgctattgtttgtttggtttggtttgttttcctgttaattgccatattgaaatgctgtagaccaaaaaggccaatgttgttgatagcctaaaactacaagaatcattgttctttcatatttaaagtggacaaagacaacttgaaatacaatccaccagtcatactctaaccaatctatggaatcaggatgagggaatatagtttagtagctaaaatgtggttatcttacctctaccacttaaagatcaccagccttgacaagagattgactagggcttgaatttctttgagcacctttaaattctctcaagtgtgttttatccacatgagttttccaagtcaatgtacactttatgtagttatgtccactcagtatttgtgatttcatcttctactatcttctgttttcttctcatatattagagttaatctgacactgtctcccccatcccacctttgaacattacctcaggttgcatgccttgcttcacctcttcattttaaacttttatatctctgtaatggttcctaagcatttaagttaaattggatccttaagaatatttttcttagtaataccatttcttgagtcagaaatcctgagactgcttattctttactaatcaattcagttggtgtcttttgtttagtgctagtggatcttgattccctagcagtccacatgttaggacagtgctctgctctgagcagcaccctcagaccaggtttttattattcattctgaggtagcaactcattgagttctttggttgtccttgaactcaatctgttgctcaggtaactcttgaaactgtgacactttgcttagcctttcaagtagtggagtgataagcatatttcaccaggtaagtgttattgtttaatgcttaataaagtattaatattgagatttttataattaagatccctattgtctacttttgccagtattttatctcttcagcatcttctagttttatacaaatcatcaagatctagttcagtgaccttaaatgacagaactttttggcatttttgtagatgtcctgtgtatgaaattatcatgcccacctgtctggagaagattccatttatattctttccctatcataatcatattgcttattacagtagcacagaaaagcacagtggtcgcatctcttagctttcattcctccttgagacaaggaatgccttcaaaaaacaagtctgaagtggtggtttcattgaaactttttcttatatatttaatgctttctatcaacttgtcccttttctttcatcagttccagaggacatctgatatagtatctgttggagaatgttcatttagcgtgggagagatgatgactccgtgtttgagagcaaatactttcctcagagcacctgaattctcagcatatacagctcgcaaccatctgtaactccagctctagtggaacttgatgcctatagtctcctatactcacgtgcacaaacccaaacacagataaatgcagagatacttgattaagagaaataaatcttttttttttaagtcagctgctgtgtggaacctctaggaagatggtgatgctaggctcctgtctgcaagcataagtgagtatggggtcaaggagtagtgcttgtccatgggatggttctacagttgggcctgttattggttggccattccctcaattcctgttccctctctgtttctacatttcttgtagacagaacaaattggggtcaaatgttttgtggatgggttagtgtccttattcctccactggacttccagtctggctactgtaggtggacttttcagattccatacccccactgctatgagtctcagataaggttacctcccccatgaaccctcaggagcctcccccatctcaggtttatggcacattcttgtaatgttcccccatacctacaacattgccaactgcagatttccattcattctccaggccctttggccccctctcctgtctcctcccacacttaaacctgaacccctcctggaaacgaatgccaacattgaatgcagcttgggactcttatgtaagatagagggactctaagggaataggaactccacagaaagaccaacagagtaactaacctggactgttagggggtctcagagactgtaccaccaatcaaagagcttatacacgctgaacctaggtcccagcacatatgtagcagatgtgtagctcaatcttcttgtggttcccccaacaactggaaaatataagcctgtctgtctctaaagctgttcactgtctgtagaatcaattcccctaagtggatggccttgtctgacctcagtgggaaaagatgtgcctagtcaggaagagagttgatatgccagggttgtgtgtgtgtgggcggggataccctaggaggggatcaaccctttcagaggagaagaggcaggatgtgagaagaaattgtgtgaggggggatggggagggggcaacattggagatgtaaagtgaattaattagtggggaaaaaagaaaataaaaaagtaaaaaaaatcataataaaagtaaattattttttaaaataattaaactgattatctcaggttgagcattagatctgtctaaagtttaacttaattaaatggcacataacacagactgtaggtgatcatttgtcatgcatttcttcaccctctacactaagttttagtgactaccacagaacttttttctccacggcattaaccctttgctttcctacatgagaattatccccaacttctcatctttcctggggctctagaaaaattctgtaacatctactttcctctcctgaattccagcaaagttctaaaagaaactcaagcgtccttctgtctcgctcccttaccatctgcccatcagccttctttctttaaacacaaaagtaagaaacagacacaacaaaatatgactcatgggttactgaaaagaatggactttattaagcagaagccctgctttcagagaccagcacagtggccatgggtatggcagagctgaggggtgtacagaatgctggacatcagggaaagggctcagtggtacttgtgggacagagcagtggccaccccaaccaccaacttctgccaggcagcctgcacctcagctgtgaattccttgccaaagtaagaagaaagaacaatcaccagcatgttacccaggagctatggaaggaaacacaaaaagatatacaaaaatgagaaaaggaaataaagaaaagaatttacaggacaaacagcatttgtaagttagtctccttgaggactccccagcagtctgtccactctaatgaggatgctggttcaatctcattgctcaagggccctcctcgaccccattcggtccttctctacttgttccttacttttcctcagtctgccacttttgtttcttgccccttttctcattcaacaatggcctggcttctacaaatacaggattaccatgtatttactagagtttcctataatgaaggaagcagggactacttatgatattactcattgggattgtaatattttttaggaagttcatcaaaccaatgagaaacatctgtcaagttttctctcgtatttttgctgaagggttagtcattagaatccacataaatagggtatttctccttccctagaacaaaatgtcaatttcaagggctagtctacttacatgtatctgctaccttctaaaataaaacacaaaagtgaggaggattctataaccaactctataagtctgctactttgtgtctttttggtagtgctccagtctcaggattcatataccccagagattcatttcatcaactgacttacataccgagacaccaaatgtctgtctgaaaaacttttctgaacagttgcaaattttaattttaattattttaaaaaataatttacttttattatgattttttttttacttttttattttcttttttccccactaattaattcactttacatctccaatgttgccccctccccatgtttcaaaatcgtgtcattttgccattgtaattgtatgtatgtgtgtgtgtgtgtgtgtatatgtataagttgtagtcttctcctctcatgtagaacactctttgcaatagacaaagaccagtacagaaatccacaaccattcaaacttcagagttgtggagcctaacctcagtggatacatctacacacctaaggatcagggaacacttcagaagaagggcaaaagattgtaagagccaaaagaccatgaagcttgctgtgatacacatttgctaatatgggtggggtaaataaagcccatgagacctcaaccatacacaaagaattacagtcaactaagggttgctgagagctggatcaagagtcttccccggggcagagcacaccaattggttacccaacaaatgcttttttaaagaaagttaattctaaattagctcttggatcttgtaaaagctttttcctaatggtaatgggatgtcacaacctgctgcaaggtatcacttgtcacccttttcttcaccctctacagtaaatgttcatatgttccatacacaatgccttctccactaaatttctttcttctctctgagaattctttctcagctttagactctcactgggcctgtagaagccttccatggcttctacgtttctctcttgagtccctgcaggtttcagataaatgcctgagtcttcctgtgcttccccctttccaaaaacacatcaaatatgtgtctttagcataaaagtagaaagcagacaagacaaaactgaatttttgattaccaggaaggatgatctttattaaacatgatgtgctttcaaggaacagtccagtattcatgtgcagaaaggaggcatagcggacacacaggattgctggacagctagagagagggctcagtggtacttgtgggacagcgcagtggccaccccagccaccagcttctgccaggcagcctgcatctcagctgtgaattcattgccgaagtgactagccaaaacaatcaccagcacattacccaagagctgttgatggaaagacaaaagaaacaaatcggtgtgttaaatgaagatttgaaacgaataagcattaaaaaaacaaagaaatattttgaacccatactctttaacacattcagcatcaaagcttcctcaatcatctctgatgagcagagattccatttttctattgttcctctttttttcccactcaccactgttctgcctggattctcataccttctattctcagcatatttatttgcctgtcgttattctcattctacagttgtctagtatctgtaaattcagaatttgtgttttcctactgctgttggtggagttttaaaactacccccaatgtaagaacaagcctccatttgtcaagatattcacctggaaatttaatacaattttatgtttattgagaaaattcaccataaggttgtcttgcaagacttttcttcaacatcaatcaataggacccacaaaaagttaagatttttccactccctattccatttcttcttgcatagatctactacttttcatattactctccatgataaatccaagaaaattttatcacgacaaaattttctaaatgtttgtaaactaatttaggtttcttacagccattcactgtcaccctactgggaccaattaattaactttgacagctaagtaagcacccccttattcatattcttggcttctcattttgtccccgagacaaatccaaaataaatttgtggcattgccctagactcactttgaagttctcaggatccacatgtagcttgtcacagtgcagttcactgagcttggccaaggcagacttgaggttgtctagattcttaatggactctccaaaagcagtcagcaccttcttgccatgggctttgacccttgggttgcccattatggcagaagcagaggacaagttcccaaagctgtcaaaaaatctatgggtccatgggtacacaacaagaagcctgtgaagtggagaaagacaagtagaaatataagggagcctcagaattcttgatttccctagctctttgtaccctaaaaacaattcttaccttcccaaggcttcaccaccaacctcttcaacattgaccttactccacaggccattgatgagggtcttttcctcagcagtaaagttcaccatgatggcaagtctgggaggttgctggtgatcacaggagtgtcagaagcaagtatgtactgctgctagaagtggtggccttttatgcttcacagacaatgttctgaccctttgttctgcattattctttgaagctattggtcagcctgacccgtggtcctcatgggtggagccaggtcatgggagggtcagcaaaaactgtacactgtgtttatgataatgcacattagatatggaggtattctttcttttttggctcctccttcaacaaaaactctctttgttttgcttattctcttttcattttctactctccacatgtaaactcccagtataacgcccatttctcttatcactttttccaacaaaggcacagaaagaggagtttagcccactataggaaaaaaaatccagtctaaaataactttaccgtttagggaaagaatggctataataataagaacaaactcatgaaaaaaggaatttgtgctgtggacacagaaatgccaatattacatctgtttctccttttcttgggatatgtgctttataactctatctcctagatatatattgccccaagtagacaagacttatacatagttgcatctggaggatgaatacagtagcaaaggattgacaatgggtccgaagactcaattccaaaatacaacaacaggaagtgacagtgtagagaagatggatataacaagttcttgttttgtgattctagagagttctctgaccaaacctttgtgaaccttactccgttagtaatattgctttgatctttttccttgcttaatcccatatagatatttctcatctgtgaggtggaactgaaataactttaaactaggcttgtgattcaactgaggaatgagtgagttgattcatcaatatccttgagaaacatttgtggatagtgtttattataactaaaggatggctagtgtgcttgatttctaatctcttcttggaattattagctatctcctacgtattggacctgaaattaaaagcctacatttgtatgtgtttaactgcatccatgtgcatgaaggatagttttacaccatcctatttaatctgcatctggcaagacagttatcattatccaccttttattcaaataaacagaatcacaaaagtgatataactgtaaggtgagagaactgttgaccaagggaggaaggctccagatttggtcacagtttggctttcctatttataggaaagttgtcctccaacctgcctctggtcagttctgcctgcatttcttccttttacctcctctatggcttcttgtgctcctaacccccctaagagtttctcttccaagactttcattttatttagtttagttctgttttattttttacatttgtttgtttttcttgtggggcccaagtgatagtgcctatttttcatttagcaatgtggcttcggtgtctcaaatctttgtgttccaaatttacccagaggatcttctctataacctttggcttgccctggcttttatgatgatttgttatgtgtctaacagccatttctgacatatgagaacacctttgttttactttcttctatgcttacagaagcattatcttgtttaaagtgtccccaaattggcattattacaagtaattgaatctctggccctctgtcagctttttctctacattatcttttgagtacagattctaacccatggccagtatagatgtgaacttatcttctcatggcatagactatttggcagactattacctactaaataatgtatatacataggattgactagaatatggatactttatacatgttaaaatagctacgtttggtgtgatgcaccttcttatgaacacattaagctaacaggatgaccatggtatccatgtcatacagactgaaagtaagcatatctgttacaactagagcataacattttaaaaaatgttctgtgggttcagtttaaagttttcttgcctataatagacagcctaggaaaatgtaactctagggtgagaaagatgttttgattgttcaagtttaagactgaatagacaaaatcagctggctgtcagcttgagtgcatccttgtttcaaaaccccaagtctgagtgtttgcctagcatgtacaaagctctgggaatggattcaattcctatggctgctacaatctttttaaaagaaagaattcaatgctgtgctaattttagatgttattagtatagaaatttttgaagtatactgtttgtagtaaattaggcccttaaacacaagtttttcagtgttaaacaagaaaaaaatagtctctacagttgttcttcatcataaatagttttaaattagaaaaattgtgagtgaagtttctgaacaggaaaaacatgttttgtaattttattaaaagaaatggtcactactctgcttccattttatgtctccattcatattcccagaacagcaataaattagatagagtaagtttcttaggtgttgcattaactaggaatgactacatactaatgacagcaaggtggaatccctgcaggaagccctaaaccttcaaggaacatgcaatggaaaatgtcaaagacactgaatgcatcagcctcatgatttgaagatgagttaaagagagagccatgtctttcttagctagaaatccctcccttttcagttcagagcagacacctgtttgactgacctctggggctatactgaaaaaccagagaagtgtctggcacttaattatcacgagagtttttactaggaagagaaaatagaaaaccatagtcagccaggtattctcttgaaactggtaacctggaacaaagtcataagtgccctattttctcccataacatcacttctctttcttggtttctttggcattttttaaaatgcttttaaaatgttaacattattgctacattgatgtgtagaagtgtaaaacatttaaacaggttctccaaagcagcaaatatatatatatttatattcccatctaaggcaggctacttgggtacttgatcagaaggaaacagatgagtcactggtctaagactactccatttttgttaagctataatttattgtcattatctaaattcaaacaaaacaagccagactgtttattaaccctatttttactttttcattggcagaaagctctcataccttctaggtaaaacaagtttctgcatttttacaatatcctataatagcttaccctatgatctatttatcatctccatggcattcttttttaacttgggtcctagagtaaataaattgtctattttcaggattaaaattctagagaactcttatctttttatgttaaataagctcacctgtgtattttataaatcaagatcaactcaccaaaaactctgacataataaaacacataggcccttttattaggtaggtactttatattttcaatattccccttcattttatactgcttcaatttataccttagggaatagccaaaattctttgttttagctagctaattacattaactaataactggtgaactttattaaaatgtagcccttcttaagtatgcactaattaaatatttgaataatgtctaaaaaagtgttgcctcaaaagccatactgatgtgcagatataagaattctatggctgaatatgattttcaaaagggttttattgtgagattagggtccatccatacttctagcgtgcaaagtgaatttggcaattattttttcactttgattttatttatttatttatttatttatttatttatttatttatttaaaatttttattacgtattttcctcaattacatttccaatgctatcccaaaagtcccccataccctcccccccccacttccctacccacccattcccattttttggccctggcgttcccctgtactggggcatataaagtttgtgtgtccaaggggcctctctttccagtgatggccgactaggccatcttttgatacatatgcagctagaggcaagagctcaggggtactggttagttcataatgttgttccacctatagggttgaagatccctttagctccttgggtactttctctagctcctccattgggagccctgcgatccatccaatagctcactgtgagcatccacttctgtgtttgctaggctccggcgtagtctcacatgagacagctatatctgggtcttttcagcaaaatcttgctagtgtatgcaatggtgtcagcgtttggaagctaattatggggtggatccctggatatggcagtctctagatggtacatccttttgtcacagctccaaactttgtctctgtaattctttccatgggtgttttgttcccaattctaagaaggtgcacagtgtccacactttggtcttcattcttgttgagtttcatgcgtttagcaaattgtatcttatatcttaggtatcctaagttttgggctaatatccacttatcagtgagtacatattgtgtgagttcctttgtgattgtgctacctcactccgaatgatgccttccaggtccatccatttgcctaggaatttcataaattcattctttttaatagctgagtagtactccattgtgtaaatgtaccacattttctgtaatcattcctctgttgaggggcatctgggttctttccagcttctggctattataaataaggctgctatgaacatagtggagcatgtgtccttcttaccggttggaacatcttctggatatatgcccaggagaggtattcctggatcctctggtagtactatgtccagttttctaaggaaccgccagactgatttccagcgtggttgtacaagcttgcaatcccaccaacaatggaggagtgttcctctttctccgaatcctcgccagcatctgctgtcacctgaatttttaatcttagccattctgactggtgtgagatggaatctcagggttgttttgatttgcatttccctgatgattaaggatgttagtgggctatcactggaaagagatgcccattggacaggcaaactttatatgccccagtacaggggaacaccagggccaaaaaatgggaatgggtgggtaggggagtgtggggggggagggtttgggggattttgggatagcattggaaatgtaattgaggaaaatacgtaataaaaaaataaggatgttgaacattttttcaggtgcttctctgctattcctcaggtgagaattctttgttcagttctgagccccatttttaatggggttatttgattttctggagtccaccttcttgcgttctttatatatattggacattagtcccctatctgatttagggtaggtaaagatcctttcccaatctgctggtggtctttttgtcttattgacggtatcttttgcctgaatttggcaatttttgatttggtaatatttgaaatttataaaaaaaaaaagtaaaaatgctatattttagctaggcatacctcttcagcatttagtgtcctaggtggaagttataacttagggaatttcctgaactgtaaactcacatctctgtgggaaaagatatgaggattggccaagtaagaagagattaaataataactaccctgacaatggccagactccatcctttagcaaggtcattcccagtgacattgtgagaaactgagaccctgtgctctttgtccctgaagttggtaatatttagtgattgttcttgccccaaaattcataacacgaaaaagccattctgaaagtaagtcatctgagcctctagttcagtgagtctaaggcatctataaacggaagaagctttcctttttcaggatcctagaccaaggtgccaagagaccaattctcaataatcctgcctcactcaagcctttgttacaatttctgactggaccaattttcttcctccatgttcttcttttttcttcttttctttcttctttcttttattcttgtttatctgtccaggggtgtaaggctttcttttattttatttaaataagtagaagtagaaagaactggtgtttttcttcttctgggacttggggtagtgtcagctgggtggggtcacagactgtggtgacagataagagccagagctgcacagagctgagtcaaggttgaggcctccgtgagattgggggaagccagtgtgtttgggctcctgccttctttgtcccatcattgctccttcatgagtagataagaggtatgtgttatgggagagtgtttgaggatctggcttaggaaagcctgataaatacgtttcatgtaatacatataaaagtgtacagatattgtaataaatgtgaggctattaccaaaattttcaagtgtaccatggcaatataatttatgaagtctacagagccaaggaaataaataaatcacattctcaaaatacaactgagatgcaatttttcaaaaaggaaaacaaacaacccaaaagatcaaaggaggggctcaaaatattataaagcaactaaaaggcttcagagcaaggggtttttaactgttgagtctgatatgtaattaaaaagttagtaattaaggaactggcctaatagaaaactgtagaaaagaacagttccctattggctaccctagagacattttggacctaacatgctttctccagaccatgactctcctttccctaaaggaaatgaataaaagtaataactgagctgttggcacaatgctagtctcataatctattcctttgcaggatgcctgccatgattgcgcacactcatgctcccactaatgcatgctaatttctaaactggagcatgtattagtataagaattttgaggctcaataagcagtaaatttgtgctaacctctatctatacctgtggttattataatcatgacctaagaaataccttggaagttctactagattggaaattagagaaattaaaaatcatctttggaacatttctacatattagaactgtcaaaacaatatcaggcaatatctctcatggatggtaactagtggcttaaaagccatggctttttggctggaagaagtttattttttctttgaagagaggaaactctgatgacagaacaaccagaggaaacacatctgtgcagagaaggcctttggttccaaagcagtggctgtagagtaactaaggagggctaggtgcttccttttcttcctccaaatgcgcatttgtaccccaaaatatcacctgtctttctggggtaattcctacatccctgatgagtacctctcatgttcacaatgatgtgagaatggtagaattcacttaaccagaatttacaatactgattctaacctaaactaaggttctgtgctagattacagggtaaatgtgaacttgccagggaactacctagtacagatccaatgaccctaactctaacaacacaggctattcccccttcctcttctacaccagacttttcataagcttacccagttaaagcaggtcagataaggaaacagggtaccagtgaatgtctgcaatgaattcaagcccattccaaatagcatttcattaacaattgcatagtttatgaacaaaactcttgtgtgtgtgtgtgtgtgtgtgtgtgtactaaaatgtgtgattctgttgcttctaggtatgagtctaaataaactttacatttataaaaaatgatttgttataacatctaataaagatcatgagaagtaatttttaactagaaaataaaatattctaggttatgtcacacagcaaggcagggtccccttttcattgtaatgctggtgtaagtaatgttttcttcaggtagcaaacttattttcttttcaccttccctgtggacttcctcctagagacccagatagcactgatcagtcacagctgaaaacatctggccacacaccctaagcctcagcatgactcagcatgactcagcactgctgtgctcaagctagatgctggctcacaaggctgaacacacccacagggtggggagtggagaactgactccgcctgggcccagctaacctcctctgcccttggacagtggtactgcaataattgagatctagagagagaatatgaagaagtggaaaactagagtttacttaaatcatagatggaagctggaaaaaatgcagaggctcgttaatgtgtaggaagcttaacagtcattcaggaaatgtttgtggaacatcggtaatatgctgatactaacatcaacacttgaggaataagtgatactaacacatgtgacctgtctgccagaagacctggtcaaaattaacagttaatcataattcaagattattatatattctgaactttgtagagattgtaaggttagaaatccatgtctttctcagtgaagatgccttttagaaagtaagggatgacatgtaatacaacgtacagaccataaactgtatttttcttattgagccctttactctctctgttcagagaaaggtgtgggaactagtcaagatgcactgactcagttgatgtagtatagccagaaaccccactgagcaggaacaggcaaggcagcttcctcatttagcacaggctgttctccctttctcttctacacaagacttttcataagcttacccagttaaagcaggtcagataaggaaacagggtaccagtgaatgtctgcaatgatttcaaggcaatttctagttaaactaagccatcaatggtcagcgttttagttggatatagagtgaaggaggtcacaactttagtctaagacctcacgaggcagggacaggcagatctctgtgagtaccagtcaatcgtgatctacatagtatgttccatgatagcatagttatatagtaaaatcctgactcaaaatgaaggaagaaaagaaagaagtaaggaaaggaggaaggaaagaaagaagaaaagaaaaaagaaaggaaaagggcagggactgcttatcctagaaatattacctacttcctctgtaagcttgagcaatttgcttggcttcttcaagttgtaaaacacagaataataatatagcttgtgttttaagcaagagccacaggcaagggaagaggataggattacaaaaactttaaaattacccttgaacccaagtatggttctaggcctttctatttgtgtggccttgaggaatctacttctcccctcaaaatttctatctcacattttacaaaatggagaaagtgaggattagggtttgaatgctggatgtctctcccaggctgtatttgaatacttaatccacaggtggctttacaatttccactatcatttgaatttctaacttaagcagattcataatattgtaaaacaatattgaggtctccaaatacaacttttcaggagatacttaaatataactcattgtacaggaaacttctctatccagcattcctatttagccattttctttttgttttgttttttaattagatatttttttatttacatttcaaatgttatcccctttcctagtttcccctcctaaaatcccctatcctctcccccctgctccccaaccagcccactcctgtttcctggccctagcattcccctatactgggacatagaaccttcacaggaccaagggcctctcctcccattgatgtccgactaggccatcctccattacatatgcagctaaagccacaaatccttccatgtgttttctttgattggtggtttagtcccagggagccctggtcattttcactctctattcaagttctcttcttcctagaatttcacgagataatgtgaagtgtctaagattagcctgagaggaacaatgccagctgacttttgaacaacagctgagagcactgtcctgacaagaatgtctataggactggtattgggttcttccatactcactgaagatgagactaatgagatgaaacacaaagctatttttgaagctgttagtatatggagtaaaatatatactagtaagacatgaggttattctattgtcagactgtgcaaatagagggtctagtaatattttgtcttaggtcgagtattcctattgtaacaacacaacatgctgcctctcttggcttattaagatctttggacctgaccagaggtaaaatgtcacagaggtgtgcactgggtgggtagatttatatggtttgaagataatgaggctttaagttaatgtcaatgaatgggaagtcagttttaggacaaaaattagtgatggaacttaatgcatgctcagtctccttaataaaatttgccagttggccaaaggcttataaggcaaattgagcatccatgacttccagttttctcaaaaaaaaaatttaaaaaaaggtacctataaataatcatctgaaaaatctctgttattcaagagagtatccttttttattctaggcattttcagcatgtctttaaattttcttctcatatattcctatgagatacagtcatgactaaagaagtagaaagtacaagtatatcttagactctattttttatatatttaatttttaagatgatatttcattttttgaggatttcctatatcatattttgatcatattcaaccctctctcctctataaggccctcccagatctgtttctacctcttcactcctcctaaatttagtatcctgttctatattgcattgaatctttttaataactttattaatccaattcagtcttcccagaagtgtgggaccgtccactggagggaggctgaactacttagaagccacagccttcaagaatggcgtcttcctccctatgaagtcaccagctgtcaatagctcctccattaaagatgtgagcctctctgcactccatgccaaaggattgactggcttgctcttttttataaatgtaattttactatttatttaacacaaagacaattctgcatgctaatgagattcaattgcttgcttctttttatagtaagaatgacagctatccttaatattcagcactgtaatatatacaacatcctcaatgcttttcagctgaaaattttgaatattccagtcatgttgagaatgctacttcacacaaacacatggtacaaaaagataggatatgcttatggtcacctggccccacatattcatgaagtaaatgttagaagaagtgattaagaagaagtttatgtttctacttctttgagcccatgataaatgatttcttcatgtcttggtgttaaaggggtattattcagcaggaacagaaatgtccctgtagtatcactttggagagctctgtgggcttctctataccatgtgctcaacaagaagtaatatgctatacatagcacaatagatagtgcactttggttataactaccagttcacatcttatatgttcttagaaattcatttatactattacatttgtgttcctttctcatcaataaagaagacaatgcatttgtgtcgtgaatgctgttgtgagcataagtacattcatgatagtaatttaaattacaatgtagcaactcagtactcaaaacctgtagccgcctgtggccacacaaactagattcctgagtgggaggccggagctgtaagggagagaacgtgaaagaagaaaagaggccaagacagatttctgatcaaggcccaatgtttgctaagagtctgtgcttataaaggggggatgccactccagactttgttgctaagttgttagcactagtctgccctaactgttagtattatgtcaccaattccacaggttgtcagctatctcaggaatatctcaggaagacaggttcagcctctcagtgggtaggagcatcttggagaagagcagtggcaggtgacagaacaatagaaccatctaggttggaaggctccaccccaggtggtctcattctcagtggcagcaaggtctaaatcagcctgcttaagacagggaggctacaaaaatcattggatttagatacacatacctcagagaatttaagtatcgtagaactacaatagcaaataacatatgtaaaaattttaattgagtactattcttaattttcctttag

SEQ ID NO: 17 - DNA, 48 bp, Homo sapiens
agatgcaggataagcaaatgggtagtgaaaagacattcatgaggacag

SEQ ID NO: 18 - DNA, 4048 bp, Homo sapiens
gtaaacagtcaaatggatatttgtatctgaaaaatcaagaatgcaattctaatcatcaagatgcatttttttattttttagttttttaattcatgtgatgtctattcttttttattattcttcaactttattgaggtatcattcacaaataaaaattgtatatatttaaggtgtacaacatgatgttttaatatatgtataccttgtgaaatgattaccacaatcaagctaattaacatacccattatctcacatagttacctttttcttgtggtaaatgcttttaagatctactctcggccaggcccggtggctcacgcctgtaatcccagccctttgggtggccgaggcaggcggatcagcctgaccaacatggagaaaccccgtctctactaaaaatacaaaattagctgggcatggtgtcgcatgcctgtaatcccagctactcgggaggctgaggcaggagatttgcttgaacccaggaggcggaggttgcagtgagccaagatcttgccattgcactccagcctggacaacaagagcaaaactccatctaaaaaaaaaaaaaaatctactctctttgcaaattttaaatatacttacagtacaattaactacagtcacgatgctgtacattagatatctagaatttattcatcccacataactgaaattttataccctttgagtaatagtttcctgattctcccacccccaacccctggaaaccatacctctactgtctgtttccatgagagtgacttttttatgtttcacatatgagcaaggttgtgtagtatttgtctttttgtgtcaggcttatttttcttagttttacatcctccaggttcatcaattctgccataaatggcaggattttcttctttttaatttttttattttcctatttttaattttttgtttgttattgaatcatctgtgtttcttatatattttggatattaaccaaaatatttaagaaatatttggtttgcaaatatgccatttcatggttcacctttcatttgttcattgttttgttttttgtgtggaaattttttagtttgatgtagcctcacttctttatttttccttttgttgcctttgcttctcatatcaaattcaaaaaacggctgcaacgtgaatattagaattttcttcttttgatttctttaaaaatttttatggttttaggtcttagtttaattctttaacccattcaaatttatttttgtttatggtgtaagacaagggtctgatttcatttcattttgagggtttcaccctctcatataataaaattcttctatatacccttctatcatcacttattactgattatatgccttgatttcagaatcttgccaactagattcagaatttgactgggagagaggacaaggaccacttgagactcatattttatttccagaatctagcatctacctacctaggtattgaataagaaaaatgaagttaaggtggttgatggtaacactatgctaataactgcagagccagaagcaccataagggacatgataagggagccagcagacctctgatctcttcctgaatgctaatcttaaacatcctgaggaagaatgggacttccatttggggtgggcctatgacagggtaataagacagtagtgaatatcaagctacaaaaagccgcctttcaaattcttctcagtcctaacttttcatactaagcccagtccttccaaagcagactgtgaaagagtgatagttccgggagactagcactgcagattccgggtcactgtgagtgggggaggcagggaagaagggctcacaggacagtcaaaccatgacccctgtttttccttcttcaagtagacctctataagacaacagagacaactaaggctgagtggccaggcgaggagaaaccatctcgccgtaaaacatggaaggaacacttcaggggaaaggtggtatctctaagcaagagaactgagtggagtcaaggctgagagatgcaggataagcaaatgggtagtgaaaagacattcatgaggacagctaaaacaataagtaatgtaaaatacagcatagcaaaactttaacctccaaatcaagcctctacttgaatccttttctgagggatgaataaggcatatgcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttagtgatacttgtgggccagggcattagccacaccagccaccactttctgataggcagcctgcactggtggggtgaattctttgccaaagtgatgggccagcacacagaccagcacgttgcccaggagctgtgggaggaagataagaggtatgaacatgattagcaaaagggcctagcttggactcagaataatccagccttatcccaaccataaaataaaagcagaatggtagctggattgtagctgctattagcaatatgaaacctcttacatcagttacaatttatatgcagaaatatttatatgcagagatattgctattgccttaacccagaaattatcactgttattctttagaatggtgcaaagaggcatgatacattgtatcattattgccctgaaagaaagagattagggaaagtattagaaataagataaacaaaaaagtatattaaaagaagaaagcattttttaaaattacaaatgcaaaattaccctgatttggtcaatatgtgtacacatattaaaacattacactttaacccataaatatgtataatgattatgtatcaattaaaaataaaagaaaataaagtagggagattatgaatatgcaaataagcacacatatattccaaatagtaatgtactaggcagactgtgtaaagtttttttttaagttacttaatgtatctcagagatatttccttttgttatacacaatgttaaggcattaagtataatagtaaaaattgcggagaagaaaaaaaaagaaagcaagaattaaacaaaagaaaacaattgttatgaacagcaaataaaagaaactaaaacgatcctgagacttccacactgatgcaatcattcgtctgtttcccattctaaactgtaccctgttacttatccccttcctatgacatgaacttaaccatagaaaagaaggggaaagaaaacatcaagcgtcccatagactcaccctgaagttctcaggatccacgtgcagcttgtcacagtgcagctcactcagtgtggcaaaggtgcccttgaggttgtccaggtgagccaggccatcactaaaggcaccgagcactttcttgccatgagccttcaccttagggttgcccataacagcatcaggagtggacagatccccaaaggactcaaagaacctctgggtccaagggtagaccaccagcagcctaagggtgggaaaatagaccaataggcagagagagtcagtgcctatcagaaacccaagagtcttctctgtctccacatgcccagtttctattggtctccttaaacctgtcttgtaaccttgataccaacctgcccagggcctcaccaccaacttcatccacgttcaccttgccccacagggcagtaacggcagacttctcctcaggagtcagatgcaccatggtgtctgtttgaggttgctagtgaacacagttgtgtcagaagcaaatgtaagcaatagatggctctgccctgacttttatgcccagccctggctcctgccctccctgctcctgggagtagattggccaaccctagggtgtggctccacagggtgaggtctaa

SEQ ID NO: 19 - DNA, 15 bp, Homo sapiens
acggctgtcatcact

SEQ ID NO: 20 - DNA, 15 bp, Homo sapiens
cggctgtcatcactt

SEQ ID NO: 21 - DNA, 15 bp, Homo sapiens
ggctgtcatcactta

SEQ ID NO: 22 - DNA, 15 bp, Homo sapiens
gctgtcatcacttag

SEQ ID NO: 23 - DNA, 15 bp, Homo sapiens
ctgtcatcacttaga

SEQ ID NO: 24 - DNA, 15 bp, Homo sapiens
tgtcatcacttagac

SEQ ID NO: 25 - DNA, 15 bp, Homo sapiens
gtcatcacttagacc

SEQ ID NO: 26 - DNA, 15 bp, Homo sapiens
tcatcacttagacct

SEQ ID NO: 27 - DNA, 15 bp, Homo sapiens
catcacttagacctc

SEQ ID NO: 28 - DNA, 15 bp, Homo sapiens
atcacttagacctca

SEQ ID NO: 29 - DNA, 15 bp, Homo sapiens
tcacttagacctcac

SEQ ID NO: 30 - DNA, 15 bp, Homo sapiens
cacttagacctcacc

SEQ ID NO: 31 - DNA, 15 bp, Homo sapiens
acttagacctcaccc

SEQ ID NO: 32 - DNA, 15 bp, Homo sapiens
cttagacctcaccct

SEQ ID NO: 33 - DNA, 15 bp, Homo sapiens
ttagacctcaccctg

SEQ ID NO: 34 - DNA, 15 bp, Homo sapiens
tagacctcaccctgt

SEQ ID NO: 35 - DNA, 15 bp, Homo sapiens
agacctcaccctgtg

SEQ ID NO: 36 - DNA, 15 bp, Homo sapiens
gacctcaccctgtgg

SEQ ID NO: 37 - DNA, 15 bp, Homo sapiens
acctcaccctgtgga

SEQ ID NO: 38 - DNA, 15 bp, Homo sapiens
cctcaccctgtggag

SEQ ID NO: 39 - DNA, 15 bp, Homo sapiens
ctcaccctgtggagc

SEQ ID NO: 40 - DNA, 15 bp, Homo sapiens
tcaccctgtggagcc

SEQ ID NO: 41 - DNA, 15 bp, Homo sapiens
caccctgtggagcca

SEQ ID NO: 42 - DNA, 15 bp, Homo sapiens
accctgtggagccac

SEQ ID NO: 43 - DNA, 15 bp, Homo sapiens
ccctgtggagccaca

SEQ ID NO: 44 - DNA, 15 bp, Homo sapiens
cctgtggagccacac

SEQ ID NO: 45 - DNA, 15 bp, Homo sapiens
ctgtggagccacacc

SEQ ID NO: 46 - DNA, 15 bp, Homo sapiens
tgtggagccacaccc

SEQ ID NO: 47 - DNA, 15 bp, Homo sapiens
gtggagccacaccct

SEQ ID NO: 48 - DNA, 15 bp, Homo sapiens
tggagccacacccta

SEQ ID NO: 49 - DNA, 15 bp, Homo sapiens
ggagccacaccctag

SEQ ID NO: 50 - DNA, 15 bp, Homo sapiens
gagccacaccctagg

SEQ ID NO: 51 - DNA, 15 bp, Homo sapiens
agccacaccctaggg

SEQ ID NO: 52 - DNA, 15 bp, Homo sapiens
gccacaccctagggt

SEQ ID NO: 53 - DNA, 15 bp, Homo sapiens
ccacaccctagggtt

SEQ ID NO: 54 - DNA, 15 bp, Homo sapiens
cacaccctagggttg

SEQ ID NO: 55 - DNA, 15 bp, Homo sapiens
acaccctagggttgg

SEQ ID NO: 56 - DNA, 15 bp, Homo sapiens
caccctagggttggc

SEQ ID NO: 57 - DNA, 15 bp, Homo sapiens
accctagggttggcc

SEQ ID NO: 58 - DNA, 15 bp, Homo sapiens
ccctagggttggcca

SEQ ID NO: 59 - DNA, 15 bp, Homo sapiens
cctagggttggccaa

SEQ ID NO: 60 - DNA, 15 bp, Homo sapiens
ctagggttggccaat

SEQ ID NO: 61 - DNA, 15 bp, Homo sapiens
tagggttggccaatc

SEQ ID NO: 62 - DNA, 15 bp, Homo sapiens
agggttggccaatct

SEQ ID NO: 63 - DNA, 15 bp, Homo sapiens
gggttggccaatcta

SEQ ID NO: 64 - DNA, 15 bp, Homo sapiens
ggttggccaatctac

SEQ ID NO: 65 - DNA, 15 bp, Homo sapiens
gttggccaatctact

SEQ ID NO: 66 - DNA, 15 bp, Homo sapiens
ttggccaatctactc

SEQ ID NO: 67 - DNA, 15 bp, Homo sapiens
tggccaatctactcc

SEQ ID NO: 68 - DNA, 15 bp, Homo sapiens
ggccaatctactccc

SEQ ID NO: 69 - DNA, 15 bp, Homo sapiens
gccaatctactccca

SEQ ID NO: 70 - DNA, 15 bp, Homo sapiens
ccaatctactcccag

SEQ ID NO: 71 - DNA, 15 bp, Homo sapiens
caatctactcccagg

SEQ ID NO: 72 - DNA, 15 bp, Homo sapiens
aatctactcccagga

SEQ ID NO: 73 - DNA, 15 bp, Homo sapiens
atctactcccaggag

SEQ ID NO: 74 - DNA, 15 bp, Homo sapiens
tctactcccaggagc

SEQ ID NO: 75 - DNA, 15 bp, Homo sapiens
ctactcccaggagca

SEQ ID NO: 76 - DNA, 15 bp, Homo sapiens
tactcccaggagcag

SEQ ID NO: 77 - DNA, 15 bp, Homo sapiens
actcccaggagcagg

SEQ ID NO: 78 - DNA, 15 bp, Homo sapiens
ctcccaggagcaggg

SEQ ID NO: 79 - DNA, 15 bp, Homo sapiens
tcccaggagcaggga

SEQ ID NO: 80 - DNA, 15 bp, Homo sapiens
cccaggagcagggag

SEQ ID NO: 81 - DNA, 15 bp, Homo sapiens
ccaggagcagggagg

SEQ ID NO: 82 - DNA, 15 bp, Homo sapiens
caggagcagggaggg

SEQ ID NO: 83 - DNA, 15 bp, Homo sapiens
aggagcagggagggc

SEQ ID NO: 84 - DNA, 15 bp, Homo sapiens
ggagcagggagggca

SEQ ID NO: 85 - DNA, 15 bp, Homo sapiens
gagcagggagggcag

SEQ ID NO: 86 - DNA, 15 bp, Homo sapiens
agcagggagggcagg

SEQ ID NO: 87 - DNA, 15 bp, Homo sapiens
gcagggagggcagga

SEQ ID NO: 88 - DNA, 15 bp, Homo sapiens
cagggagggcaggag

SEQ ID NO: 89 - DNA, 15 bp, Homo sapiens
agggagggcaggagc

SEQ ID NO: 90 - DNA, 15 bp, Homo sapiens
gggagggcaggagcc

SEQ ID NO: 91 - DNA, 15 bp, Homo sapiens
ggagggcaggagcca

SEQ ID NO: 92 - DNA, 15 bp, Homo sapiens
gagggcaggagccag

SEQ ID NO: 93 - DNA, 15 bp, Homo sapiens
agggcaggagccagg

SEQ ID NO: 94 - DNA, 15 bp, Homo sapiens
gggcaggagccaggg

SEQ ID NO: 95 - DNA, 15 bp, Homo sapiens
ggcaggagccagggc

SEQ ID NO: 96 - DNA, 15 bp, Homo sapiens
gcaggagccagggct

SEQ ID NO: 97 - DNA, 15 bp, Homo sapiens
caggagccagggctg

SEQ ID NO: 98 - DNA, 15 bp, Homo sapiens
aggagccagggctgg

SEQ ID NO: 99 - DNA, 15 bp, Homo sapiens
ggagccagggctggg

SEQ ID NO: 100 - DNA, 15 bp, Homo sapiens
gagccagggctgggc

SEQ ID NO: 101 - DNA, 15 bp, Homo sapiens
agccagggctgggca

SEQ ID NO: 102 - DNA, 15 bp, Homo sapiens
gccagggctgggcat

SEQ ID NO: 103 - DNA, 15 bp, Homo sapiens
ccagggctgggcata

SEQ ID NO: 104 - DNA, 15 bp, Homo sapiens
cagggctgggcataa

SEQ ID NO: 105 - DNA, 15 bp, Homo sapiens
agggctgggcataaa

SEQ ID NO: 106 - DNA, 15 bp, Homo sapiens
gggctgggcataaaa

SEQ ID NO: 107 - DNA, 15 bp, Homo sapiens
ggctgggcataaaag

SEQ ID NO: 108 - DNA, 15 bp, Homo sapiens
gctgggcataaaagt

SEQ ID NO: 109 - DNA, 15 bp, Homo sapiens
ctgggcataaaagtc

SEQ ID NO: 110 - DNA, 15 bp, Homo sapiens
tgggcataaaagtca

SEQ ID NO: 111 - DNA, 15 bp, Homo sapiens
gggcataaaagtcag

SEQ ID NO: 112 - DNA, 15 bp, Homo sapiens
ggcataaaagtcagg

SEQ ID NO: 113 - DNA, 15 bp, Homo sapiens
gcataaaagtcaggg

SEQ ID NO: 114 - DNA, 15 bp, Homo sapiens
cataaaagtcagggc

SEQ ID NO: 115 - DNA, 15 bp, Homo sapiens
ataaaagtcagggca

SEQ ID NO: 116 - DNA, 15 bp, Homo sapiens
taaaagtcagggcag

SEQ ID NO: 117 - DNA, 15 bp, Homo sapiens
aaaagtcagggcaga

SEQ ID NO: 118 - DNA, 15 bp, Homo sapiens
aaagtcagggcagag

SEQ ID NO: 119 - DNA, 15 bp, Homo sapiens
aagtcagggcagagc

SEQ ID NO: 120 - DNA, 15 bp, Homo sapiens
agtcagggcagagcc

SEQ ID NO: 121 - DNA, 15 bp, Homo sapiens
gtcagggcagagcca

SEQ ID NO: 122 - DNA, 15 bp, Homo sapiens
tcagggcagagccat

SEQ ID NO: 123 - DNA, 15 bp, Homo sapiens
cagggcagagccatc

SEQ ID NO: 124 - DNA, 15 bp, Homo sapiens
agggcagagccatct

SEQ ID NO: 125 - DNA, 15 bp, Homo sapiens
gggcagagccatcta

SEQ ID NO: 126 - DNA, 15 bp, Homo sapiens
ggcagagccatctat

SEQ ID NO: 127 - DNA, 15 bp, Homo sapiens
gcagagccatctatt

SEQ ID NO: 128 - DNA, 15 bp, Homo sapiens
cagagccatctattg

SEQ ID NO: 129 - DNA, 15 bp, Homo sapiens
agagccatctattgc

SEQ ID NO: 130 - DNA, 15 bp, Homo sapiens
gagccatctattgct

SEQ ID NO: 131 - DNA, 15 bp, Homo sapiens
agccatctattgctt

SEQ ID NO: 132 - DNA, 15 bp, Homo sapiens
gccatctattgctta

SEQ ID NO: 133 - DNA, 15 bp, Homo sapiens
ccatctattgcttac

SEQ ID NO: 134 - DNA, 15 bp, Homo sapiens
catctattgcttaca

SEQ ID NO: 135 - DNA, 15 bp, Homo sapiens
atctattgcttacat

SEQ ID NO: 136 - DNA, 15 bp, Homo sapiens
tctattgcttacatt

SEQ ID NO: 137 - DNA, 15 bp, Homo sapiens
ctattgcttacattt

SEQ ID NO: 138 - DNA, 15 bp, Homo sapiens
tattgcttacatttg

SEQ ID NO: 139 - DNA, 15 bp, Homo sapiens
attgcttacatttgc

SEQ ID NO: 140 - DNA, 15 bp, Homo sapiens
ttgcttacatttgct

SEQ ID NO: 141 - DNA, 15 bp, Homo sapiens
tgcttacatttgctt

SEQ ID NO: 142 - DNA, 15 bp, Homo sapiens
gcttacatttgcttc

SEQ ID NO: 143 - DNA, 15 bp, Homo sapiens
cttacatttgcttct

SEQ ID NO: 144 - DNA, 15 bp, Homo sapiens
ttacatttgcttctg

SEQ ID NO: 145 - DNA, 15 bp, Homo sapiens
tacatttgcttctga

SEQ ID NO: 146 - DNA, 15 bp, Homo sapiens
acatttgcttctgac

SEQ ID NO: 147 - DNA, 15 bp, Homo sapiens
catttgcttctgaca

SEQ ID NO: 148 - DNA, 15 bp, Homo sapiens
atttgcttctgacac

SEQ ID NO: 149 - DNA, 15 bp, Homo sapiens
tttgcttctgacaca

SEQ ID NO: 150 - DNA, 15 bp, Homo sapiens
ttgcttctgacacaa

SEQ ID NO: 151 - DNA, 15 bp, Homo sapiens
tgcttctgacacaac

SEQ ID NO: 152 - DNA, 15 bp, Homo sapiens
gcttctgacacaact

SEQ ID NO: 153 - DNA, 15 bp, Homo sapiens
cttctgacacaactg

SEQ ID NO: 154 - DNA, 15 bp, Homo sapiens
ttctgacacaactgt

SEQ ID NO: 155 - DNA, 15 bp, Homo sapiens
tctgacacaactgtg

SEQ ID NO: 156 - DNA, 15 bp, Homo sapiens
ctgacacaactgtgt

SEQ ID NO: 157 - DNA, 15 bp, Homo sapiens
tgacacaactgtgtt

SEQ ID NO: 158 - DNA, 15 bp, Homo sapiens
gacacaactgtgttc

SEQ ID NO: 159 - DNA, 15 bp, Homo sapiens
acacaactgtgttca

SEQ ID NO: 160 - DNA, 15 bp, Homo sapiens
cacaactgtgttcac

SEQ ID NO: 161 - DNA, 15 bp, Homo sapiens
acaactgtgttcact

SEQ ID NO: 162 - DNA, 15 bp, Homo sapiens
caactgtgttcacta

SEQ ID NO: 163 - DNA, 15 bp, Homo sapiens
aactgtgttcactag

SEQ ID NO: 164 - DNA, 15 bp, Homo sapiens
actgtgttcactagc

SEQ ID NO: 165 - DNA, 15 bp, Homo sapiens
ctgtgttcactagca

SEQ ID NO: 166 - DNA, 15 bp, Homo sapiens
tgtgttcactagcaa

SEQ ID NO: 167 - DNA, 15 bp, Homo sapiens
ctcctgaggagaagt

SEQ ID NO: 168 - DNA, 15 bp, Homo sapiens
tcctgaggagaagtc

SEQ ID NO: 169 - DNA, 15 bp, Homo sapiens
cctgaggagaagtct

SEQ ID NO: 170 - DNA, 15 bp, Homo sapiens
ctgaggagaagtctg

SEQ ID NO: 171 - DNA, 15 bp, Homo sapiens
tgaggagaagtctgc

SEQ ID NO: 172 - DNA, 15 bp, Homo sapiens
gaggagaagtctgcc

SEQ ID NO: 173 - DNA, 15 bp, Homo sapiens
aggagaagtctgccg

SEQ ID NO: 174 - DNA, 15 bp, Homo sapiens
ggagaagtctgccgt

SEQ ID NO: 175 - DNA, 15 bp, Homo sapiens
gagaagtctgccgtt

SEQ ID NO: 176 - DNA, 15 bp, Homo sapiens
agaagtctgccgtta

SEQ ID NO: 177 - DNA, 15 bp, Homo sapiens
gaagtctgccgttac

SEQ ID NO: 178 - DNA, 15 bp, Homo sapiens
aagtctgccgttact

SEQ ID NO: 179 - DNA, 15 bp, Homo sapiens
agtctgccgttactg

SEQ ID NO: 180 - DNA, 15 bp, Homo sapiens
gtctgccgttactgc

SEQ ID NO: 181 - DNA, 15 bp, Homo sapiens
tctgccgttactgcc

SEQ ID NO: 182 - DNA, 15 bp, Homo sapiens
ctgccgttactgccc

SEQ ID NO: 183 - DNA, 15 bp, Homo sapiens
tgccgttactgccct

SEQ ID NO: 184 - DNA, 15 bp, Homo sapiens
gccgttactgccctg

SEQ ID NO: 185 - DNA, 15 bp, Homo sapiens
ccgttactgccctgt

SEQ ID NO: 186 - DNA, 15 bp, Homo sapiens
cgttactgccctgtg

SEQ ID NO: 187 - DNA, 15 bp, Homo sapiens
gttactgccctgtgg

SEQ ID NO: 188 - DNA, 15 bp, Homo sapiens
ttactgccctgtggg

SEQ ID NO: 189 - DNA, 15 bp, Homo sapiens
tactgccctgtgggg

SEQ ID NO: 190 - DNA, 15 bp, Homo sapiens
actgccctgtggggc

SEQ ID NO: 191 - DNA, 15 bp, Homo sapiens
ctgccctgtggggca

SEQ ID NO: 192 - DNA, 15 bp, Homo sapiens
gccctgtggggcaag

SEQ ID NO: 193 - DNA, 15 bp, Homo sapiens
ccctgtggggcaagg

SEQ ID NO: 194 - DNA, 15 bp, Homo sapiens
cctgtggggcaaggt

SEQ ID NO: 195 - DNA, 15 bp, Homo sapiens
ctgtggggcaaggtg

SEQ ID NO: 196 - DNA, 15 bp, Homo sapiens
tgtggggcaaggtga

SEQ ID NO: 197 - DNA, 15 bp, Homo sapiens
gtggggcaaggtgaa

SEQ ID NO: 198 - DNA, 15 bp, Homo sapiens
tggggcaaggtgaac

SEQ ID NO: 199 - DNA, 15 bp, Homo sapiens
ggggcaaggtgaacg

SEQ ID NO: 200 - DNA, 15 bp, Homo sapiens
gggcaaggtgaacgt

SEQ ID NO: 201 - DNA, 15 bp, Homo sapiens
ggcaaggtgaacgtg

SEQ ID NO: 202 - DNA, 15 bp, Homo sapiens
gcaaggtgaacgtgg

SEQ ID NO: 203 - DNA, 15 bp, Homo sapiens
caaggtgaacgtgga

SEQ ID NO: 204 - DNA, 15 bp, Homo sapiens
aaggtgaacgtggat

SEQ ID NO: 205 - DNA, 15 bp, Homo sapiens
aggtgaacgtggatg

SEQ ID NO: 206 - DNA, 15 bp, Homo sapiens
ggtgaacgtggatga

SEQ ID NO: 207 - DNA, 15 bp, Homo sapiens
gtgaacgtggatgaa

SEQ ID NO: 208 - DNA, 15 bp, Homo sapiens
tgaacgtggatgaag

SEQ ID NO: 209 - DNA, 15 bp, Homo sapiens
gaacgtggatgaagt

SEQ ID NO: 210 - DNA, 15 bp, Homo sapiens
aacgtggatgaagtt

SEQ ID NO: 211 - DNA, 15 bp, Homo sapiens
acgtggatgaagttg

SEQ ID NO: 212 - DNA, 15 bp, Homo sapiens
cgtggatgaagttgg

SEQ ID NO: 213 - DNA, 15 bp, Homo sapiens
gtggatgaagttggt

SEQ ID NO: 214 - DNA, 15 bp, Homo sapiens
tggatgaagttggtg

SEQ ID NO: 215 - DNA, 15 bp, Homo sapiens
ggatgaagttggtgg

SEQ ID NO: 216 - DNA, 15 bp, Homo sapiens
gatgaagttggtggt

SEQ ID NO: 217 - DNA, 15 bp, Homo sapiens
atgaagttggtggtg

SEQ ID NO: 218 - DNA, 15 bp, Homo sapiens
tgaagttggtggtga

SEQ ID NO: 219 - DNA, 15 bp, Homo sapiens
gaagttggtggtgag

SEQ ID NO: 220 - DNA, 15 bp, Homo sapiens
aagttggtggtgagg

SEQ ID NO: 221 - DNA, 15 bp, Homo sapiens
tggtatcaaggttac

SEQ ID NO: 222 - DNA, 15 bp, Homo sapiens
ggtatcaaggttaca

SEQ ID NO: 223 - DNA, 15 bp, Homo sapiens
gtatcaaggttacaa

SEQ ID NO: 224 - DNA, 15 bp, Homo sapiens
tatcaaggttacaag

SEQ ID NO: 225 - DNA, 15 bp, Homo sapiens
atcaaggttacaaga

SEQ ID NO: 226 - DNA, 15 bp, Homo sapiens
tcaaggttacaagac

SEQ ID NO: 227 - DNA, 15 bp, Homo sapiens
caaggttacaagaca

SEQ ID NO: 228 - DNA, 15 bp, Homo sapiens
aaggttacaagacag

SEQ ID NO: 229 - DNA, 15 bp, Homo sapiens
aggttacaagacagg

SEQ ID NO: 230 - DNA, 15 bp, Homo sapiens
ggttacaagacaggt

SEQ ID NO: 231 - DNA, 15 bp, Homo sapiens
gttacaagacaggtt

SEQ ID NO: 232 - DNA, 15 bp, Homo sapiens
ttacaagacaggttt

SEQ ID NO: 233 - DNA, 15 bp, Homo sapiens
tacaagacaggttta

SEQ ID NO: 234 - DNA, 15 bp, Homo sapiens
acaagacaggtttaa

SEQ ID NO: 235 - DNA, 15 bp, Homo sapiens
caagacaggtttaag

SEQ ID NO: 236 - DNA, 15 bp, Homo sapiens
aagacaggtttaagg

SEQ ID NO: 237 - DNA, 15 bp, Homo sapiens
agacaggtttaagga

SEQ ID NO: 238 - DNA, 15 bp, Homo sapiens
gacaggtttaaggag

SEQ ID NO: 239 - DNA, 15 bp, Homo sapiens
acaggtttaaggaga

SEQ ID NO: 240 - DNA, 15 bp, Homo sapiens
caggtttaaggagac

SEQ ID NO: 241 - DNA, 15 bp, Homo sapiens
aggtttaaggagacc

SEQ ID NO: 242 - DNA, 15 bp, Homo sapiens
ggtttaaggagacca

SEQ ID NO: 243 - DNA, 15 bp, Homo sapiens
gtttaaggagaccaa

SEQ ID NO: 244 - DNA, 15 bp, Homo sapiens
tttaaggagaccaat

SEQ ID NO: 245 - DNA, 15 bp, Homo sapiens
ttaaggagaccaata

SEQ ID NO: 246 - DNA, 15 bp, Homo sapiens
taaggagaccaatag

SEQ ID NO: 247 - DNA, 15 bp, Homo sapiens
aaggagaccaataga

SEQ ID NO: 248 - DNA, 15 bp, Homo sapiens
aggagaccaatagaa

SEQ ID NO: 249 - DNA, 15 bp, Homo sapiens
ggagaccaatagaaa

SEQ ID NO: 250 - DNA, 15 bp, Homo sapiens
gagaccaatagaaac

SEQ ID NO: 251 - DNA, 15 bp, Homo sapiens
agaccaatagaaact

SEQ ID NO: 252 - DNA, 15 bp, Homo sapiens
gaccaatagaaactg

SEQ ID NO: 253 - DNA, 15 bp, Homo sapiens
accaatagaaactgg

SEQ ID NO: 254 - DNA, 15 bp, Homo sapiens
ccaatagaaactggg

SEQ ID NO: 255 - DNA, 15 bp, Homo sapiens
caatagaaactgggc

SEQ ID NO: 256 - DNA, 15 bp, Homo sapiens
aatagaaactgggca

SEQ ID NO: 257 - DNA, 15 bp, Homo sapiens
atagaaactgggcat

SEQ ID NO: 258 - DNA, 15 bp, Homo sapiens
tagaaactgggcatg

SEQ ID NO: 259 - DNA, 15 bp, Homo sapiens
agaaactgggcatgt

SEQ ID NO: 260 - DNA, 15 bp, Homo sapiens
aaactgggcatgtgg

SEQ ID NO: 261 - DNA, 15 bp, Homo sapiens
aactgggcatgtgga

SEQ ID NO: 262 - DNA, 15 bp, Homo sapiens
actgggcatgtggag

SEQ ID NO: 263 - DNA, 15 bp, Homo sapiens
ctgggcatgtggaga

SEQ ID NO: 264 - DNA, 15 bp, Homo sapiens
tgggcatgtggagac

SEQ ID NO: 265 - DNA, 15 bp, Homo sapiens
gggcatgtggagaca

SEQ ID NO: 266 - DNA, 15 bp, Homo sapiens
ggcatgtggagacag

SEQ ID NO: 267 - DNA, 15 bp, Homo sapiens
gcatgtggagacaga

SEQ ID NO: 268 - DNA, 15 bp, Homo sapiens
catgtggagacagag

SEQ ID NO: 269 - DNA, 15 bp, Homo sapiens
atgtggagacagaga

SEQ ID NO: 270 - DNA, 15 bp, Homo sapiens
tgtggagacagagaa

SEQ ID NO: 271 - DNA, 15 bp, Homo sapiens
gtggagacagagaag

SEQ ID NO: 272 - DNA, 15 bp, Homo sapiens
tggagacagagaaga

SEQ ID NO: 273 - DNA, 15 bp, Homo sapiens
ggagacagagaagac

SEQ ID NO: 274 - DNA, 15 bp, Homo sapiens
gagacagagaagact

SEQ ID NO: 275 - DNA, 15 bp, Homo sapiens
ggcactgactctctc

SEQ ID NO: 276 - DNA, 15 bp, Homo sapiens
gcactgactctctct

SEQ ID NO: 277 - DNA, 15 bp, Homo sapiens
cactgactctctctg

SEQ ID NO: 278 - DNA, 15 bp, Homo sapiens
actgactctctctgc

SEQ ID NO: 279 - DNA, 15 bp, Homo sapiens
ctgactctctctgcc

SEQ ID NO: 280 - DNA, 15 bp, Homo sapiens
tgactctctctgcct

SEQ ID NO: 281 - DNA, 15 bp, Homo sapiens
gactctctctgccta

SEQ ID NO: 282 - DNA, 15 bp, Homo sapiens
actctctctgcctat

SEQ ID NO: 283 - DNA, 15 bp, Homo sapiens
ctctctctgcctatt

SEQ ID NO: 284 - DNA, 15 bp, Homo sapiens
tctctctgcctattg

SEQ ID NO: 285 - DNA, 15 bp, Homo sapiens
ctctctgcctattgg

SEQ ID NO: 286 - DNA, 15 bp, Homo sapiens
tctctgcctattggt

SEQ ID NO: 287 - DNA, 15 bp, Homo sapiens
ctctgcctattggtc

SEQ ID NO: 288 - DNA, 15 bp, Homo sapiens
tctgcctattggtct

SEQ ID NO: 289 - DNA, 15 bp, Homo sapiens
ctgcctattggtcta

SEQ ID NO: 290 - DNA, 15 bp, Homo sapiens
tgcctattggtctat

SEQ ID NO: 291 - DNA, 15 bp, Homo sapiens
gcctattggtctatt

SEQ ID NO: 292 - DNA, 15 bp, Homo sapiens
cctattggtctattt

SEQ ID NO: 293 - DNA, 15 bp, Homo sapiens
ctattggtctatttt

SEQ ID NO: 294 - DNA, 15 bp, Homo sapiens
tattggtctattttc

SEQ ID NO: 295 - DNA, 15 bp, Homo sapiens
attggtctattttcc

SEQ ID NO: 296 - DNA, 15 bp, Homo sapiens
ttggtctattttccc

SEQ ID NO: 297 - DNA, 15 bp, Homo sapiens
tggtctattttccca

SEQ ID NO: 298 - DNA, 15 bp, Homo sapiens
ggtctattttcccac

SEQ ID NO: 299 - DNA, 15 bp, Homo sapiens
gtctattttcccacc

SEQ ID NO: 300 - DNA, 15 bp, Homo sapiens
tctattttcccaccc

SEQ ID NO: 301 - DNA, 15 bp, Homo sapiens
ctattttcccaccct

SEQ ID NO: 302 - DNA, 15 bp, Homo sapiens
tattttcccaccctt

SEQ ID NO: 303 - DNA, 15 bp, Homo sapiens
attttcccaccctta

SEQ ID NO: 304 - DNA, 15 bp, Homo sapiens
ttttcccacccttag

SEQ ID NO: 305 - DNA, 15 bp, Homo sapiens
tttcccacccttagg

SEQ ID NO: 306 - DNA, 15 bp, Homo sapiens
ttcccacccttaggc

SEQ ID NO: 307 - DNA, 15 bp, Homo sapiens
tcccacccttaggct

SEQ ID NO: 308 - DNA, 15 bp, Homo sapiens
cccacccttaggctg

SEQ ID NO: 309 - DNA, 15 bp, Homo sapiens
ccacccttaggctgc

SEQ ID NO: 310 - DNA, 15 bp, Homo sapiens
cacccttaggctgct

SEQ ID NO: 311 - DNA, 15 bp, Homo sapiens
acccttaggctgctg

SEQ ID NO: 312 - DNA, 15 bp, Homo sapiens
cccttaggctgctgg

SEQ ID NO: 313 - DNA, 15 bp, Homo sapiens
ccttaggctgctggt

SEQ ID NO: 314 - DNA, 15 bp, Homo sapiens
cttaggctgctggtg

SEQ ID NO: 315 - DNA, 15 bp, Homo sapiens
ttaggctgctggtgg

SEQ ID NO: 316 - DNA, 15 bp, Homo sapiens
taggctgctggtggt

SEQ ID NO: 317 - DNA, 15 bp, Homo sapiens
aggctgctggtggtc

SEQ ID NO: 318 - DNA, 15 bp, Homo sapiens
ggctgctggtggtct

SEQ ID NO: 319 - DNA, 15 bp, Homo sapiens
gctgctggtggtcta

SEQ ID NO: 320 - DNA, 15 bp, Homo sapiens
ctgctggtggtctac

SEQ ID NO: 321 - DNA, 15 bp, Homo sapiens
tgctggtggtctacc

SEQ ID NO: 322 - DNA, 15 bp, Homo sapiens
gctggtggtctaccc

SEQ ID NO: 323 - DNA, 15 bp, Homo sapiens
ttggggatctgtcca

SEQ ID NO: 324 - DNA, 15 bp, Homo sapiens
tggggatctgtccac

SEQ ID NO: 325 - DNA, 15 bp, Homo sapiens
ggggatctgtccact

SEQ ID NO: 326 - DNA, 15 bp, Homo sapiens
gggatctgtccactc

SEQ ID NO: 327 - DNA, 15 bp, Homo sapiens
ggatctgtccactcc

SEQ ID NO: 328 - DNA, 15 bp, Homo sapiens
gatctgtccactcct

SEQ ID NO: 329 - DNA, 15 bp, Homo sapiens
atctgtccactcctg

SEQ ID NO: 330 - DNA, 15 bp, Homo sapiens
tctgtccactcctga

SEQ ID NO: 331 - DNA, 15 bp, Homo sapiens
ctgtccactcctgat

SEQ ID NO: 332 - DNA, 15 bp, Homo sapiens
tgtccactcctgatg

SEQ ID NO: 333 - DNA, 15 bp, Homo sapiens
gtccactcctgatgc

SEQ ID NO: 334 - DNA, 15 bp, Homo sapiens
tccactcctgatgct

SEQ ID NO: 335 - DNA, 15 bp, Homo sapiens
ccactcctgatgctg

SEQ ID NO: 336 - DNA, 15 bp, Homo sapiens
cactcctgatgctgt

SEQ ID NO: 337 - DNA, 15 bp, Homo sapiens
actcctgatgctgtt

SEQ ID NO: 338 - DNA, 15 bp, Homo sapiens
gctcatggcaagaaa

SEQ ID NO: 339 - DNA, 15 bp, Homo sapiens
ctcatggcaagaaag

SEQ ID NO: 340 - DNA, 15 bp, Homo sapiens
tcatggcaagaaagt

SEQ ID NO: 341 - DNA, 15 bp, Homo sapiens
catggcaagaaagtg

SEQ ID NO: 342 - DNA, 15 bp, Homo sapiens
atggcaagaaagtgc

SEQ ID NO: 343 - DNA, 15 bp, Homo sapiens
tggcaagaaagtgct

SEQ ID NO: 344 - DNA, 15 bp, Homo sapiens
ggcaagaaagtgctc

SEQ ID NO: 345 - DNA, 15 bp, Homo sapiens
gcaagaaagtgctcg

SEQ ID NO: 346 - DNA, 15 bp, Homo sapiens
caagaaagtgctcgg

SEQ ID NO: 347 - DNA, 15 bp, Homo sapiens
aagaaagtgctcggt

SEQ ID NO: 348 - DNA, 15 bp, Homo sapiens
agaaagtgctcggtg

SEQ ID NO: 349 - DNA, 15 bp, Homo sapiens
gaaagtgctcggtgc

SEQ ID NO: 350 - DNA, 15 bp, Homo sapiens
aaagtgctcggtgcc

SEQ ID NO: 351 - DNA, 15 bp, Homo sapiens
aagtgctcggtgcct

SEQ ID NO: 352 - DNA, 15 bp, Homo sapiens
agtgctcggtgcctt

SEQ ID NO: 353 - DNA, 15 bp, Homo sapiens
gtgctcggtgccttt

SEQ ID NO: 354 - DNA, 15 bp, Homo sapiens
tgctcggtgccttta

SEQ ID NO: 355 - DNA, 15 bp, Homo sapiens
gctcggtgcctttag

SEQ ID NO: 356 - DNA, 15 bp, Homo sapiens
ctcggtgcctttagt

SEQ ID NO: 357 - DNA, 15 bp, Homo sapiens
tcggtgcctttagtg

SEQ ID NO: 358 - DNA, 15 bp, Homo sapiens
cggtgcctttagtga

SEQ ID NO: 359 - DNA, 15 bp, Homo sapiens
aacctcaagggcacc

SEQ ID NO: 360 - DNA, 15 bp, Homo sapiens
acctcaagggcacct

SEQ ID NO: 361 - DNA, 15 bp, Homo sapiens
cctcaagggcacctt

SEQ ID NO: 362 - DNA, 15 bp, Homo sapiens
ctcaagggcaccttt

SEQ ID NO: 363 - DNA, 15 bp, Homo sapiens
tcaagggcacctttg

SEQ ID NO: 364 - DNA, 15 bp, Homo sapiens
caagggcacctttgc

SEQ ID NO: 365 - DNA, 15 bp, Homo sapiens
aagggcacctttgcc

SEQ ID NO: 366 - DNA, 15 bp, Homo sapiens
agggcacctttgcca

SEQ ID NO: 367 - DNA, 15 bp, Homo sapiens
gggcacctttgccac

SEQ ID NO: 368 - DNA, 15 bp, Homo sapiens
ggcacctttgccaca

SEQ ID NO: 369 - DNA, 15 bp, Homo sapiens
gcacctttgccacac

SEQ ID NO: 370 - DNA, 15 bp, Homo sapiens
cacctttgccacact

SEQ ID NO: 371 - DNA, 15 bp, Homo sapiens
acctttgccacactg

SEQ ID NO: 372 - DNA, 15 bp, Homo sapiens
cctttgccacactga

SEQ ID NO: 373 - DNA, 15 bp, Homo sapiens
ctttgccacactgag

SEQ ID NO: 374 - DNA, 15 bp, Homo sapiens
tttgccacactgagt

SEQ ID NO: 375 - DNA, 15 bp, Homo sapiens
ttgccacactgagtg

SEQ ID NO: 376 - DNA, 15 bp, Homo sapiens
tgccacactgagtga

SEQ ID NO: 377 - DNA, 15 bp, Homo sapiens
gccacactgagtgag

SEQ ID NO: 378 - DNA, 15 bp, Homo sapiens
ccacactgagtgagc

SEQ ID NO: 379 - DNA, 15 bp, Homo sapiens
cacactgagtgagct

SEQ ID NO: 380 - DNA, 15 bp, Homo sapiens
acactgagtgagctg

SEQ ID NO: 381 - DNA, 15 bp, Homo sapiens
cactgagtgagctgc

SEQ ID NO: 382 - DNA, 15 bp, Homo sapiens
actgagtgagctgca

SEQ ID NO: 383 - DNA, 15 bp, Homo sapiens
cttcagggtgagtct

SEQ ID NO: 384 - DNA, 15 bp, Homo sapiens
ttcagggtgagtcta

SEQ ID NO: 385 - DNA, 15 bp, Homo sapiens
tcagggtgagtctat

SEQ ID NO: 386 - DNA, 15 bp, Homo sapiens
cagggtgagtctatg

SEQ ID NO: 387 - DNA, 15 bp, Homo sapiens
agggtgagtctatgg

SEQ ID NO: 388 - DNA, 15 bp, Homo sapiens
gggtgagtctatggg

SEQ ID NO: 389 - DNA, 15 bp, Homo sapiens
ggtgagtctatggga

SEQ ID NO: 390 - DNA, 15 bp, Homo sapiens
gtgagtctatgggac

SEQ ID NO: 391 - DNA, 15 bp, Homo sapiens
tgagtctatgggacg

SEQ ID NO: 392 - DNA, 15 bp, Homo sapiens
gagtctatgggacgc

SEQ ID NO: 393 - DNA, 15 bp, Homo sapiens
agtctatgggacgct

SEQ ID NO: 394 - DNA, 15 bp, Homo sapiens
gtctatgggacgctt

SEQ ID NO: 395 - DNA, 15 bp, Homo sapiens
tctatgggacgcttg

SEQ ID NO: 396 - DNA, 15 bp, Homo sapiens
ctatgggacgcttga

SEQ ID NO: 397 - DNA, 15 bp, Homo sapiens
tatgggacgcttgat

SEQ ID NO: 398 - DNA, 15 bp, Homo sapiens
atgggacgcttgatg

SEQ ID NO: 399 - DNA, 15 bp, Homo sapiens
tgggacgcttgatgt

SEQ ID NO: 400 - DNA, 15 bp, Homo sapiens
gggacgcttgatgtt

SEQ ID NO: 401 - DNA, 15 bp, Homo sapiens
ggacgcttgatgttt

SEQ ID NO: 402 - DNA, 15 bp, Homo sapiens
gacgcttgatgtttt

SEQ ID NO: 403 - DNA, 15 bp, Homo sapiens
acgcttgatgttttc

SEQ ID NO: 404 - DNA, 15 bp, Homo sapiens
cgcttgatgttttct

SEQ ID NO: 405 - DNA, 15 bp, Homo sapiens
gcttgatgttttctt

SEQ ID NO: 406 - DNA, 15 bp, Homo sapiens
cttgatgttttcttt

SEQ ID NO: 407 - DNA, 15 bp, Homo sapiens
ttgatgttttctttc

SEQ ID NO: 408 - DNA, 15 bp, Homo sapiens
tgatgttttctttcc

SEQ ID NO: 409 - DNA, 15 bp, Homo sapiens
gatgttttctttccc

SEQ ID NO: 410 - DNA, 15 bp, Homo sapiens
atgttttctttcccc

SEQ ID NO: 411 - DNA, 15 bp, Homo sapiens
tgttttctttcccct

SEQ ID NO: 412 - DNA, 15 bp, Homo sapiens
gttttctttcccctt

SEQ ID NO: 413 - DNA, 15 bp, Homo sapiens
ttttctttccccttc

SEQ ID NO: 414 - DNA, 15 bp, Homo sapiens
tttctttccccttct

SEQ ID NO: 415 - DNA, 15 bp, Homo sapiens
ttctttccccttctt

SEQ ID NO: 416 - DNA, 15 bp, Homo sapiens
tctttccccttcttt

SEQ ID NO: 417 - DNA, 15 bp, Homo sapiens
ctttccccttctttt

SEQ ID NO: 418 - DNA, 15 bp, Homo sapiens
tttccccttcttttc

SEQ ID NO: 419 - DNA, 15 bp, Homo sapiens
ttccccttcttttct

SEQ ID NO: 420 - DNA, 15 bp, Homo sapiens
tccccttcttttcta

SEQ ID NO: 421 - DNA, 15 bp, Homo sapiens
ccccttcttttctat

SEQ ID NO: 422 - DNA, 15 bp, Homo sapiens
cccttcttttctatg

SEQ ID NO: 423 - DNA, 15 bp, Homo sapiens
ccttcttttctatgg

SEQ ID NO: 424 - DNA, 15 bp, Homo sapiens
cttcttttctatggt

SEQ ID NO: 425 - DNA, 15 bp, Homo sapiens
ttcttttctatggtt

SEQ ID NO: 426 - DNA, 15 bp, Homo sapiens
tcttttctatggtta

SEQ ID NO: 427 - DNA, 15 bp, Homo sapiens
cttttctatggttaa

SEQ ID NO: 428 - DNA, 15 bp, Homo sapiens
ttttctatggttaag

SEQ ID NO: 429 - DNA, 15 bp, Homo sapiens
tttctatggttaagt

SEQ ID NO: 430 - DNA, 15 bp, Homo sapiens
ttctatggttaagtt

SEQ ID NO: 431 - DNA, 15 bp, Homo sapiens
tctatggttaagttc

SEQ ID NO: 432 - DNA, 15 bp, Homo sapiens
ctatggttaagttca

SEQ ID NO: 433 - DNA, 15 bp, Homo sapiens
tatggttaagttcat

SEQ ID NO: 434 - DNA, 15 bp, Homo sapiens
atggttaagttcatg

SEQ ID NO: 435 - DNA, 15 bp, Homo sapiens
tggttaagttcatgt

SEQ ID NO: 436 - DNA, 15 bp, Homo sapiens
ggttaagttcatgtc

SEQ ID NO: 437 - DNA, 15 bp, Homo sapiens
gttaagttcatgtca

SEQ ID NO: 438 - DNA, 15 bp, Homo sapiens
ttaagttcatgtcat

SEQ ID NO: 439 - DNA, 15 bp, Homo sapiens
taagttcatgtcata

SEQ ID NO: 440 - DNA, 15 bp, Homo sapiens
aagttcatgtcatag

SEQ ID NO: 441 - DNA, 15 bp, Homo sapiens
agttcatgtcatagg

SEQ ID NO: 442 - DNA, 15 bp, Homo sapiens
gttcatgtcatagga

SEQ ID NO: 443 - DNA, 15 bp, Homo sapiens
ttcatgtcataggaa

SEQ ID NO: 444 - DNA, 15 bp, Homo sapiens
tcatgtcataggaag

SEQ ID NO: 445 - DNA, 15 bp, Homo sapiens
catgtcataggaagg

SEQ ID NO: 446 - DNA, 15 bp, Homo sapiens
atgtcataggaaggg

SEQ ID NO: 447 - DNA, 15 bp, Homo sapiens
tgtcataggaagggg

SEQ ID NO: 448 - DNA, 15 bp, Homo sapiens
gtcataggaagggga

SEQ ID NO: 449 - DNA, 15 bp, Homo sapiens
tcataggaaggggat

SEQ ID NO: 450 - DNA, 15 bp, Homo sapiens
cataggaaggggata

SEQ ID NO: 451 - DNA, 15 bp, Homo sapiens
ataggaaggggataa

SEQ ID NO: 452 - DNA, 15 bp, Homo sapiens
taggaaggggataag

SEQ ID NO: 453 - DNA, 15 bp, Homo sapiens
aggaaggggataagt

SEQ ID NO: 454 - DNA, 15 bp, Homo sapiens
ggaaggggataagta

SEQ ID NO: 455 - DNA, 15 bp, Homo sapiens
gaaggggataagtaa

SEQ ID NO: 456 - DNA, 15 bp, Homo sapiens
aaggggataagtaac

SEQ ID NO: 457 - DNA, 15 bp, Homo sapiens
aggggataagtaaca

SEQ ID NO: 458 - DNA, 15 bp, Homo sapiens
ggggataagtaacag

SEQ ID NO: 459 - DNA, 15 bp, Homo sapiens
gggataagtaacagg

SEQ ID NO: 460 - DNA, 15 bp, Homo sapiens
ggataagtaacaggg

SEQ ID NO: 461 - DNA, 15 bp, Homo sapiens
gataagtaacagggt

SEQ ID NO: 462 - DNA, 15 bp, Homo sapiens
ataagtaacagggta

SEQ ID NO: 463 - DNA, 15 bp, Homo sapiens
taagtaacagggtac

SEQ ID NO: 464 - DNA, 15 bp, Homo sapiens
aagtaacagggtaca

SEQ ID NO: 465 - DNA, 15 bp, Homo sapiens
agtaacagggtacag

SEQ ID NO: 466 - DNA, 15 bp, Homo sapiens
gtaacagggtacagt

SEQ ID NO: 467 - DNA, 15 bp, Homo sapiens
taacagggtacagtt

SEQ ID NO: 468 - DNA, 15 bp, Homo sapiens
aacagggtacagttt

SEQ ID NO: 469 - DNA, 15 bp, Homo sapiens
acagggtacagttta

SEQ ID NO: 470 - DNA, 15 bp, Homo sapiens
cagggtacagtttag

SEQ ID NO: 471 - DNA, 15 bp, Homo sapiens
agggtacagtttaga

SEQ ID NO: 472 - DNA, 15 bp, Homo sapiens
gggtacagtttagaa

SEQ ID NO: 473 - DNA, 15 bp, Homo sapiens
ggtacagtttagaat

SEQ ID NO: 474 - DNA, 15 bp, Homo sapiens
gtacagtttagaatg

SEQ ID NO: 475 - DNA, 15 bp, Homo sapiens
tacagtttagaatgg

SEQ ID NO: 476 - DNA, 15 bp, Homo sapiens
acagtttagaatggg

SEQ ID NO: 477 - DNA, 15 bp, Homo sapiens
cagtttagaatggga

SEQ ID NO: 478 - DNA, 15 bp, Homo sapiens
agtttagaatgggaa

SEQ ID NO: 479 - DNA, 15 bp, Homo sapiens
gtttagaatgggaaa

SEQ ID NO: 480 - DNA, 15 bp, Homo sapiens
tttagaatgggaaac

SEQ ID NO: 481 - DNA, 15 bp, Homo sapiens
ttagaatgggaaaca

SEQ ID NO: 482 - DNA, 15 bp, Homo sapiens
tagaatgggaaacag

SEQ ID NO: 483 - DNA, 15 bp, Homo sapiens
agaatgggaaacaga

SEQ ID NO: 484 - DNA, 15 bp, Homo sapiens
gaatgggaaacagac

SEQ ID NO: 485 - DNA, 15 bp, Homo sapiens
aatgggaaacagacg

SEQ ID NO: 486 - DNA, 15 bp, Homo sapiens
atgggaaacagacga

SEQ ID NO: 487 - DNA, 15 bp, Homo sapiens
tgggaaacagacgaa

SEQ ID NO: 488 - DNA, 15 bp, Homo sapiens
gggaaacagacgaat

SEQ ID NO: 489 - DNA, 15 bp, Homo sapiens
ggaaacagacgaatg

SEQ ID NO: 490 - DNA, 15 bp, Homo sapiens
gaaacagacgaatga

SEQ ID NO: 491 - DNA, 15 bp, Homo sapiens
aaacagacgaatgat

SEQ ID NO: 492 - DNA, 15 bp, Homo sapiens
aacagacgaatgatt

SEQ ID NO: 493 - DNA, 15 bp, Homo sapiens
acagacgaatgattg

SEQ ID NO: 494 - DNA, 15 bp, Homo sapiens
cagacgaatgattgc

SEQ ID NO: 495 - DNA, 15 bp, Homo sapiens
agacgaatgattgca

SEQ ID NO: 496 - DNA, 15 bp, Homo sapiens
gacgaatgattgcat

SEQ ID NO: 497 - DNA, 15 bp, Homo sapiens
acgaatgattgcatc

SEQ ID NO: 498 - DNA, 15 bp, Homo sapiens
cgaatgattgcatca

SEQ ID NO: 499 - DNA, 15 bp, Homo sapiens
gaatgattgcatcag

SEQ ID NO: 500 - DNA, 15 bp, Homo sapiens
aatgattgcatcagt

SEQ ID NO: 501 - DNA, 15 bp, Homo sapiens
atgattgcatcagtg

SEQ ID NO: 502 - DNA, 15 bp, Homo sapiens
tgattgcatcagtgt

SEQ ID NO: 503 - DNA, 15 bp, Homo sapiens
gattgcatcagtgtg

SEQ ID NO: 504 - DNA, 15 bp, Homo sapiens
attgcatcagtgtgg

SEQ ID NO: 505 - DNA, 15 bp, Homo sapiens
ttgcatcagtgtgga

SEQ ID NO: 506 - DNA, 15 bp, Homo sapiens
tgcatcagtgtggaa

SEQ ID NO: 507 - DNA, 15 bp, Homo sapiens
gcatcagtgtggaag

SEQ ID NO: 508 - DNA, 15 bp, Homo sapiens
catcagtgtggaagt

SEQ ID NO: 509 - DNA, 15 bp, Homo sapiens
atcagtgtggaagtc

SEQ ID NO: 510 - DNA, 15 bp, Homo sapiens
tcagtgtggaagtct

SEQ ID NO: 511 - DNA, 15 bp, Homo sapiens
cagtgtggaagtctc

SEQ ID NO: 512 - DNA, 15 bp, Homo sapiens
agtgtggaagtctca

SEQ ID NO: 513 - DNA, 15 bp, Homo sapiens
gtgtggaagtctcag

SEQ ID NO: 514 - DNA, 15 bp, Homo sapiens
tgtggaagtctcagg

SEQ ID NO: 515 - DNA, 15 bp, Homo sapiens
gtggaagtctcagga

SEQ ID NO: 516 - DNA, 15 bp, Homo sapiens
tggaagtctcaggat

SEQ ID NO: 517 - DNA, 15 bp, Homo sapiens
ggaagtctcaggatc

SEQ ID NO: 518 - DNA, 15 bp, Homo sapiens
gaagtctcaggatcg

SEQ ID NO: 519 - DNA, 15 bp, Homo sapiens
aagtctcaggatcgt

SEQ ID NO: 520 - DNA, 15 bp, Homo sapiens
agtctcaggatcgtt

SEQ ID NO: 521 - DNA, 15 bp, Homo sapiens
gtctcaggatcgttt

SEQ ID NO: 522 - DNA, 15 bp, Homo sapiens
tctcaggatcgtttt

SEQ ID NO: 523 - DNA, 15 bp, Homo sapiens
ctcaggatcgtttta

SEQ ID NO: 524 - DNA, 15 bp, Homo sapiens
tcaggatcgttttag

SEQ ID NO: 525 - DNA, 15 bp, Homo sapiens
caggatcgttttagt

SEQ ID NO: 526 - DNA, 15 bp, Homo sapiens
aggatcgttttagtt

SEQ ID NO: 527 - DNA, 15 bp, Homo sapiens
ggatcgttttagttt

SEQ ID NO: 528 - DNA, 15 bp, Homo sapiens
gatcgttttagtttc

SEQ ID NO: 529 - DNA, 15 bp, Homo sapiens
atcgttttagtttct

SEQ ID NO: 530 - DNA, 15 bp, Homo sapiens
tcgttttagtttctt

SEQ ID NO: 531 - DNA, 15 bp, Homo sapiens
cgttttagtttcttt

SEQ ID NO: 532 - DNA, 15 bp, Homo sapiens
gttttagtttctttt

SEQ ID NO: 533 - DNA, 15 bp, Homo sapiens
ttttagtttctttta

SEQ ID NO: 534 - DNA, 15 bp, Homo sapiens
tttagtttcttttat

SEQ ID NO: 535 - DNA, 15 bp, Homo sapiens
ttagtttcttttatt

SEQ ID NO: 536 - DNA, 15 bp, Homo sapiens
tagtttcttttattt

SEQ ID NO: 537 - DNA, 15 bp, Homo sapiens
agtttcttttatttg

SEQ ID NO: 538 - DNA, 15 bp, Homo sapiens
gtttcttttatttgc

SEQ ID NO: 539 - DNA, 15 bp, Homo sapiens
tttcttttatttgct

SEQ ID NO: 540 - DNA, 15 bp, Homo sapiens
ttcttttatttgctg

SEQ ID NO: 541 - DNA, 15 bp, Homo sapiens
tcttttatttgctgt

SEQ ID NO: 542 - DNA, 15 bp, Homo sapiens
cttttatttgctgtt

SEQ ID NO: 543 - DNA, 15 bp, Homo sapiens
ttttatttgctgttc

SEQ ID NO: 544 - DNA, 15 bp, Homo sapiens
tttatttgctgttca

SEQ ID NO: 545 - DNA, 15 bp, Homo sapiens
ttatttgctgttcat

SEQ ID NO: 546 - DNA, 15 bp, Homo sapiens
tatttgctgttcata

SEQ ID NO: 547 - DNA, 15 bp, Homo sapiens
atttgctgttcataa

SEQ ID NO: 548 - DNA, 15 bp, Homo sapiens
tttgctgttcataac

SEQ ID NO: 549 - DNA, 15 bp, Homo sapiens
ttgctgttcataaca

SEQ ID NO: 550 - DNA, 15 bp, Homo sapiens
tgctgttcataacaa

SEQ ID NO: 551 - DNA, 15 bp, Homo sapiens
gctgttcataacaat

SEQ ID NO: 552 - DNA, 15 bp, Homo sapiens
ctgttcataacaatt

SEQ ID NO: 553 - DNA, 15 bp, Homo sapiens
tgttcataacaattg

SEQ ID NO: 554 - DNA, 15 bp, Homo sapiens
gttcataacaattgt

SEQ ID NO: 555 - DNA, 15 bp, Homo sapiens
ttcataacaattgtt

SEQ ID NO: 556 - DNA, 15 bp, Homo sapiens
tcataacaattgttt

SEQ ID NO: 557 - DNA, 15 bp, Homo sapiens
cataacaattgtttt

SEQ ID NO: 558 - DNA, 15 bp, Homo sapiens
ataacaattgttttc

SEQ ID NO: 559 - DNA, 15 bp, Homo sapiens
taacaattgttttct

SEQ ID NO: 560 - DNA, 15 bp, Homo sapiens
aacaattgttttctt

SEQ ID NO: 561 - DNA, 15 bp, Homo sapiens
acaattgttttcttt

SEQ ID NO: 562 - DNA, 15 bp, Homo sapiens
caattgttttctttt

SEQ ID NO: 563 - DNA, 15 bp, Homo sapiens
aattgttttcttttg

SEQ ID NO: 564 - DNA, 15 bp, Homo sapiens
attgttttcttttgt

SEQ ID NO: 565 - DNA, 15 bp, Homo sapiens
ttgttttcttttgtt

SEQ ID NO: 566 - DNA, 15 bp, Homo sapiens
tgttttcttttgttt

SEQ ID NO: 567 - DNA, 15 bp, Homo sapiens
gttttcttttgttta

SEQ ID NO: 568 - DNA, 15 bp, Homo sapiens
ttttcttttgtttaa

SEQ ID NO: 569 - DNA, 15 bp, Homo sapiens
tttcttttgtttaat

SEQ ID NO: 570 - DNA, 15 bp, Homo sapiens
ttcttttgtttaatt

SEQ ID NO: 571 - DNA, 15 bp, Homo sapiens
tcttttgtttaattc

SEQ ID NO: 572 - DNA, 15 bp, Homo sapiens
cttttgtttaattct

SEQ ID NO: 573 - DNA, 15 bp, Homo sapiens
ttttgtttaattctt

SEQ ID NO: 574 - DNA, 15 bp, Homo sapiens
tttgtttaattcttg

SEQ ID NO: 575 - DNA, 15 bp, Homo sapiens
ttgtttaattcttgc

SEQ ID NO: 576 - DNA, 15 bp, Homo sapiens
tgtttaattcttgct

SEQ ID NO: 577 - DNA, 15 bp, Homo sapiens
gtttaattcttgctt

SEQ ID NO: 578 - DNA, 15 bp, Homo sapiens
tttaattcttgcttt

SEQ ID NO: 579 - DNA, 15 bp, Homo sapiens
ttaattcttgctttc

SEQ ID NO: 580 - DNA, 15 bp, Homo sapiens
taattcttgctttct

SEQ ID NO: 581 - DNA, 15 bp, Homo sapiens
aattcttgctttctt

SEQ ID NO: 582 - DNA, 15 bp, Homo sapiens
attcttgctttcttt

SEQ ID NO: 583 - DNA, 15 bp, Homo sapiens
ttcttgctttctttt

SEQ ID NO: 584 - DNA, 15 bp, Homo sapiens
tcttgctttcttttt

SEQ ID NO: 585 - DNA, 15 bp, Homo sapiens
cttgctttctttttt

SEQ ID NO: 586 - DNA, 15 bp, Homo sapiens
ttgctttcttttttt

SEQ ID NO: 587 - DNA, 15 bp, Homo sapiens
tgctttctttttttt

SEQ ID NO: 588 - DNA, 15 bp, Homo sapiens
gctttcttttttttt

SEQ ID NO: 589 - DNA, 15 bp, Homo sapiens
ctttctttttttttc

SEQ ID NO: 590 - DNA, 15 bp, Homo sapiens
tttctttttttttct

SEQ ID NO: 591 - DNA, 15 bp, Homo sapiens
ttctttttttttctt

SEQ ID NO: 592 - DNA, 15 bp, Homo sapiens
tctttttttttcttc

SEQ ID NO: 593 - DNA, 15 bp, Homo sapiens
ctttttttttcttct

SEQ ID NO: 594 - DNA, 15 bp, Homo sapiens
tttttttttcttctc

SEQ ID NO: 595 - DNA, 15 bp, Homo sapiens
ttttttttcttctcc

SEQ ID NO: 596 - DNA, 15 bp, Homo sapiens
tttttttcttctccg

SEQ ID NO: 597 - DNA, 15 bp, Homo sapiens
ttttttcttctccgc

SEQ ID NO: 598 - DNA, 15 bp, Homo sapiens
tttttcttctccgca

SEQ ID NO: 599 - DNA, 15 bp, Homo sapiens
ttttcttctccgcaa

SEQ ID NO: 600 - DNA, 15 bp, Homo sapiens
tttcttctccgcaat

SEQ ID NO: 601 - DNA, 15 bp, Homo sapiens
ttcttctccgcaatt

SEQ ID NO: 602 - DNA, 15 bp, Homo sapiens
tcttctccgcaattt

SEQ ID NO: 603 - DNA, 15 bp, Homo sapiens
cttctccgcaatttt

SEQ ID NO: 604 - DNA, 15 bp, Homo sapiens
ttctccgcaattttt

SEQ ID NO: 605 - DNA, 15 bp, Homo sapiens
tctccgcaattttta

SEQ ID NO: 606 - DNA, 15 bp, Homo sapiens
ctccgcaatttttac

SEQ ID NO: 607 - DNA, 15 bp, Homo sapiens
tccgcaatttttact

SEQ ID NO: 608 - DNA, 15 bp, Homo sapiens
ccgcaatttttacta

SEQ ID NO: 609 - DNA, 15 bp, Homo sapiens
cgcaatttttactat

SEQ ID NO: 610 - DNA, 15 bp, Homo sapiens
gcaatttttactatt

SEQ ID NO: 611 - DNA, 15 bp, Homo sapiens
caatttttactatta

SEQ ID NO: 612 - DNA, 15 bp, Homo sapiens
aatttttactattat

SEQ ID NO: 613 - DNA, 15 bp, Homo sapiens
atttttactattata

SEQ ID NO: 614 - DNA, 15 bp, Homo sapiens
tttttactattatac

SEQ ID NO: 615 - DNA, 15 bp, Homo sapiens
ttttactattatact

SEQ ID NO: 616 - DNA, 15 bp, Homo sapiens
tttactattatactt

SEQ ID NO: 617 - DNA, 15 bp, Homo sapiens
ttactattatactta

SEQ ID NO: 618 - DNA, 15 bp, Homo sapiens
tactattatacttaa

SEQ ID NO: 619 - DNA, 15 bp, Homo sapiens
actattatacttaat

SEQ ID NO: 620 - DNA, 15 bp, Homo sapiens
ctattatacttaatg

SEQ ID NO: 621 - DNA, 15 bp, Homo sapiens
tattatacttaatgc

SEQ ID NO: 622 - DNA, 15 bp, Homo sapiens
attatacttaatgcc

SEQ ID NO: 623 - DNA, 15 bp, Homo sapiens
ttatacttaatgcct

SEQ ID NO: 624 - DNA, 15 bp, Homo sapiens
tatacttaatgcctt

SEQ ID NO: 625 - DNA, 15 bp, Homo sapiens
atacttaatgcctta

SEQ ID NO: 626 - DNA, 15 bp, Homo sapiens
tacttaatgccttaa

SEQ ID NO: 627 - DNA, 15 bp, Homo sapiens
acttaatgccttaac

SEQ ID NO: 628 - DNA, 15 bp, Homo sapiens
cttaatgccttaaca

SEQ ID NO: 629 - DNA, 15 bp, Homo sapiens
ttaatgccttaacat

SEQ ID NO: 630 - DNA, 15 bp, Homo sapiens
taatgccttaacatt

SEQ ID NO: 631 - DNA, 15 bp, Homo sapiens
aatgccttaacattg

SEQ ID NO: 632 - DNA, 15 bp, Homo sapiens
atgccttaacattgt

SEQ ID NO: 633 - DNA, 15 bp, Homo sapiens
tgccttaacattgtg

SEQ ID NO: 634 - DNA, 15 bp, Homo sapiens
gccttaacattgtgt

SEQ ID NO: 635 - DNA, 15 bp, Homo sapiens
ccttaacattgtgta

SEQ ID NO: 636 - DNA, 15 bp, Homo sapiens
cttaacattgtgtat

SEQ ID NO: 637 - DNA, 15 bp, Homo sapiens
ttaacattgtgtata

SEQ ID NO: 638 - DNA, 15 bp, Homo sapiens
taacattgtgtataa

SEQ ID NO: 639 - DNA, 15 bp, Homo sapiens
aacattgtgtataac

SEQ ID NO: 640 - DNA, 15 bp, Homo sapiens
acattgtgtataaca

SEQ ID NO: 641 - DNA, 15 bp, Homo sapiens
cattgtgtataacaa

SEQ ID NO: 642 - DNA, 15 bp, Homo sapiens
attgtgtataacaaa

SEQ ID NO: 643 - DNA, 15 bp, Homo sapiens
ttgtgtataacaaaa

SEQ ID NO: 644 - DNA, 15 bp, Homo sapiens
tgtgtataacaaaag

SEQ ID NO: 645 - DNA, 15 bp, Homo sapiens
gtgtataacaaaagg

SEQ ID NO: 646 - DNA, 15 bp, Homo sapiens
tgtataacaaaagga

SEQ ID NO: 647 - DNA, 15 bp, Homo sapiens
gtataacaaaaggaa

SEQ ID NO: 648 - DNA, 15 bp, Homo sapiens
tataacaaaaggaaa

SEQ ID NO: 649 - DNA, 15 bp, Homo sapiens
ataacaaaaggaaat

SEQ ID NO: 650 - DNA, 15 bp, Homo sapiens
taacaaaaggaaata

SEQ ID NO: 651 - DNA, 15 bp, Homo sapiens
aacaaaaggaaatat

SEQ ID NO: 652 - DNA, 15 bp, Homo sapiens
acaaaaggaaatatc

SEQ ID NO: 653 - DNA, 15 bp, Homo sapiens
caaaaggaaatatct

SEQ ID NO: 654 - DNA, 15 bp, Homo sapiens
aaaaggaaatatctc

SEQ ID NO: 655 - DNA, 15 bp, Homo sapiens
aaaggaaatatctct

SEQ ID NO: 656 - DNA, 15 bp, Homo sapiens
aaggaaatatctctg

SEQ ID NO: 657 - DNA, 15 bp, Homo sapiens
aggaaatatctctga

SEQ ID NO: 658 - DNA, 15 bp, Homo sapiens
ggaaatatctctgag

SEQ ID NO: 659 - DNA, 15 bp, Homo sapiens
gaaatatctctgaga

SEQ ID NO: 660 - DNA, 15 bp, Homo sapiens
aaatatctctgagat

SEQ ID NO: 661 - DNA, 15 bp, Homo sapiens
aatatctctgagata

SEQ ID NO: 662 - DNA, 15 bp, Homo sapiens
atatctctgagatac

SEQ ID NO: 663 - DNA, 15 bp, Homo sapiens
tatctctgagataca

SEQ ID NO: 664 - DNA, 15 bp, Homo sapiens
atctctgagatacat

SEQ ID NO: 665 - DNA, 15 bp, Homo sapiens
tctctgagatacatt

SEQ ID NO: 666 - DNA, 15 bp, Homo sapiens
ctctgagatacatta

SEQ ID NO: 667 - DNA, 15 bp, Homo sapiens
tctgagatacattaa

SEQ ID NO: 668 - DNA, 15 bp, Homo sapiens
ctgagatacattaag

SEQ ID NO: 669 - DNA, 15 bp, Homo sapiens
tgagatacattaagt

SEQ ID NO: 670 - DNA, 15 bp, Homo sapiens
gagatacattaagta

SEQ ID NO: 671 - DNA, 15 bp, Homo sapiens
agatacattaagtaa

SEQ ID NO: 672 - DNA, 15 bp, Homo sapiens
gatacattaagtaac

SEQ ID NO: 673 - DNA, 15 bp, Homo sapiens
atacattaagtaact

SEQ ID NO: 674 - DNA, 15 bp, Homo sapiens
tacattaagtaactt

SEQ ID NO: 675 - DNA, 15 bp, Homo sapiens
acattaagtaactta

SEQ ID NO: 676 - DNA, 15 bp, Homo sapiens
cattaagtaacttaa

SEQ ID NO: 677 - DNA, 15 bp, Homo sapiens
attaagtaacttaaa

SEQ ID NO: 678 - DNA, 15 bp, Homo sapiens
ttaagtaacttaaaa

SEQ ID NO: 679 - DNA, 15 bp, Homo sapiens
taagtaacttaaaaa

SEQ ID NO: 680 - DNA, 15 bp, Homo sapiens
aagtaacttaaaaaa

SEQ ID NO: 681 - DNA, 15 bp, Homo sapiens
agtaacttaaaaaaa

SEQ ID NO: 682 - DNA, 15 bp, Homo sapiens
gtaacttaaaaaaaa

SEQ ID NO: 683 - DNA, 15 bp, Homo sapiens
taacttaaaaaaaaa

SEQ ID NO: 684 - DNA, 15 bp, Homo sapiens
aacttaaaaaaaaac

SEQ ID NO: 685 - DNA, 15 bp, Homo sapiens
acttaaaaaaaaact

SEQ ID NO: 686 - DNA, 15 bp, Homo sapiens
cttaaaaaaaaactt

SEQ ID NO: 687 - DNA, 15 bp, Homo sapiens
ttaaaaaaaaacttt

SEQ ID NO: 688 - DNA, 15 bp, Homo sapiens
taaaaaaaaacttta

SEQ ID NO: 689 - DNA, 15 bp, Homo sapiens
aaaaaaaaactttac

SEQ ID NO: 690 - DNA, 15 bp, Homo sapiens
aaaaaaaactttaca

SEQ ID NO: 691 - DNA, 15 bp, Homo sapiens
aaaaaaactttacac

SEQ ID NO: 692 - DNA, 15 bp, Homo sapiens
aaaaaactttacaca

SEQ ID NO: 693 - DNA, 15 bp, Homo sapiens
aaaaactttacacag

SEQ ID NO: 694 - DNA, 15 bp, Homo sapiens
aaaactttacacagt

SEQ ID NO: 695 - DNA, 15 bp, Homo sapiens
aaactttacacagtc

SEQ ID NO: 696 - DNA, 15 bp, Homo sapiens
aactttacacagtct

SEQ ID NO: 697 - DNA, 15 bp, Homo sapiens
actttacacagtctg

SEQ ID NO: 698 - DNA, 15 bp, Homo sapiens
ctttacacagtctgc

SEQ ID NO: 699 - DNA, 15 bp, Homo sapiens
tttacacagtctgcc

SEQ ID NO: 700 - DNA, 15 bp, Homo sapiens
ttacacagtctgcct

SEQ ID NO: 701 - DNA, 15 bp, Homo sapiens
tacacagtctgccta

SEQ ID NO: 702 - DNA, 15 bp, Homo sapiens
acacagtctgcctag

SEQ ID NO: 703 - DNA, 15 bp, Homo sapiens
cacagtctgcctagt

SEQ ID NO: 704 - DNA, 15 bp, Homo sapiens
acagtctgcctagta

SEQ ID NO: 705 - DNA, 15 bp, Homo sapiens
cagtctgcctagtac

SEQ ID NO: 706 - DNA, 15 bp, Homo sapiens
agtctgcctagtaca

SEQ ID NO: 707 - DNA, 15 bp, Homo sapiens
gtctgcctagtacat

SEQ ID NO: 708 - DNA, 15 bp, Homo sapiens
tctgcctagtacatt

SEQ ID NO: 709 - DNA, 15 bp, Homo sapiens
ctgcctagtacatta

SEQ ID NO: 710 - DNA, 15 bp, Homo sapiens
tgcctagtacattac

SEQ ID NO: 711 - DNA, 15 bp, Homo sapiens
gcctagtacattact

SEQ ID NO: 712 - DNA, 15 bp, Homo sapiens
cctagtacattacta

SEQ ID NO: 713 - DNA, 15 bp, Homo sapiens
ctagtacattactat

SEQ ID NO: 714 - DNA, 15 bp, Homo sapiens
tagtacattactatt

SEQ ID NO: 715 - DNA, 15 bp, Homo sapiens
agtacattactattt

SEQ ID NO: 716 - DNA, 15 bp, Homo sapiens
gtacattactatttg

SEQ ID NO: 717 - DNA, 15 bp, Homo sapiens
tacattactatttgg

SEQ ID NO: 718 - DNA, 15 bp, Homo sapiens
acattactatttgga

SEQ ID NO: 719 - DNA, 15 bp, Homo sapiens
cattactatttggaa

SEQ ID NO: 720 - DNA, 15 bp, Homo sapiens
attactatttggaat

SEQ ID NO: 721 - DNA, 15 bp, Homo sapiens
ttactatttggaata

SEQ ID NO: 722 - DNA, 15 bp, Homo sapiens
tactatttggaatat

SEQ ID NO: 723 - DNA, 15 bp, Homo sapiens
actatttggaatata

SEQ ID NO: 724 - DNA, 15 bp, Homo sapiens
ctatttggaatatat

SEQ ID NO: 725 - DNA, 15 bp, Homo sapiens
tatttggaatatatg

SEQ ID NO: 726 - DNA, 15 bp, Homo sapiens
atttggaatatatgt

SEQ ID NO: 727 - DNA, 15 bp, Homo sapiens
tttggaatatatgtg

SEQ ID NO: 728 - DNA, 15 bp, Homo sapiens
ttggaatatatgtgt

SEQ ID NO: 729 - DNA, 15 bp, Homo sapiens
tggaatatatgtgtg

SEQ ID NO: 730 - DNA, 15 bp, Homo sapiens
ggaatatatgtgtgc

SEQ ID NO: 731 - DNA, 15 bp, Homo sapiens
gaatatatgtgtgct

SEQ ID NO: 732 - DNA, 15 bp, Homo sapiens
aatatatgtgtgctt

SEQ ID NO: 733 - DNA, 15 bp, Homo sapiens
atatatgtgtgctta

SEQ ID NO: 734 - DNA, 15 bp, Homo sapiens
tatatgtgtgcttat

SEQ ID NO: 735 - DNA, 15 bp, Homo sapiens
atatgtgtgcttatt

SEQ ID NO: 736 - DNA, 15 bp, Homo sapiens
tatgtgtgcttattt

SEQ ID NO: 737 - DNA, 15 bp, Homo sapiens
atgtgtgcttatttg

SEQ ID NO: 738 - DNA, 15 bp, Homo sapiens
tgtgtgcttatttgc

SEQ ID NO: 739 - DNA, 15 bp, Homo sapiens
gtgtgcttatttgca

SEQ ID NO: 740 - DNA, 15 bp, Homo sapiens
tgtgcttatttgcat

SEQ ID NO: 741 - DNA, 15 bp, Homo sapiens
gtgcttatttgcata

SEQ ID NO: 742 - DNA, 15 bp, Homo sapiens
tgcttatttgcatat

SEQ ID NO: 743 - DNA, 15 bp, Homo sapiens
gcttatttgcatatt

SEQ ID NO: 744 - DNA, 15 bp, Homo sapiens
cttatttgcatattc

SEQ ID NO: 745 - DNA, 15 bp, Homo sapiens
ttatttgcatattca

SEQ ID NO: 746 - DNA, 15 bp, Homo sapiens
tatttgcatattcat

SEQ ID NO: 747 - DNA, 15 bp, Homo sapiens
atttgcatattcata

SEQ ID NO: 748 - DNA, 15 bp, Homo sapiens
tttgcatattcataa

SEQ ID NO: 749 - DNA, 15 bp, Homo sapiens
ttgcatattcataat

SEQ ID NO: 750 - DNA, 15 bp, Homo sapiens
tgcatattcataatc

SEQ ID NO: 751 - DNA, 15 bp, Homo sapiens
gcatattcataatct

SEQ ID NO: 752 - DNA, 15 bp, Homo sapiens
catattcataatctc

SEQ ID NO: 753 - DNA, 15 bp, Homo sapiens
atattcataatctcc

SEQ ID NO: 754 - DNA, 15 bp, Homo sapiens
tattcataatctccc

SEQ ID NO: 755 - DNA, 15 bp, Homo sapiens
attcataatctccct

SEQ ID NO: 756 - DNA, 15 bp, Homo sapiens
ttcataatctcccta

SEQ ID NO: 757 - DNA, 15 bp, Homo sapiens
tcataatctccctac

SEQ ID NO: 758 - DNA, 15 bp, Homo sapiens
cataatctccctact

SEQ ID NO: 759 - DNA, 15 bp, Homo sapiens
ataatctccctactt

SEQ ID NO: 760 - DNA, 15 bp, Homo sapiens
taatctccctacttt

SEQ ID NO: 761 - DNA, 15 bp, Homo sapiens
aatctccctacttta

SEQ ID NO: 762 - DNA, 15 bp, Homo sapiens
atctccctactttat

SEQ ID NO: 763 - DNA, 15 bp, Homo sapiens
tctccctactttatt

SEQ ID NO: 764 - DNA, 15 bp, Homo sapiens
ctccctactttattt

SEQ ID NO: 765 - DNA, 15 bp, Homo sapiens
tccctactttatttt

SEQ ID NO: 766 - DNA, 15 bp, Homo sapiens
ccctactttattttc

SEQ ID NO: 767 - DNA, 15 bp, Homo sapiens
cctactttattttct

SEQ ID NO: 768 - DNA, 15 bp, Homo sapiens
ctactttattttctt

SEQ ID NO: 769 - DNA, 15 bp, Homo sapiens
tactttattttcttt

SEQ ID NO: 770 - DNA, 15 bp, Homo sapiens
actttattttctttt

SEQ ID NO: 771 - DNA, 15 bp, Homo sapiens
ctttattttctttta

SEQ ID NO: 772 - DNA, 15 bp, Homo sapiens
tttattttcttttat

SEQ ID NO: 773 - DNA, 15 bp, Homo sapiens
ttattttcttttatt

SEQ ID NO: 774 - DNA, 15 bp, Homo sapiens
tattttcttttattt

SEQ ID NO: 775 - DNA, 15 bp, Homo sapiens
attttcttttatttt

SEQ ID NO: 776 - DNA, 15 bp, Homo sapiens
ttttcttttattttt

SEQ ID NO: 777 - DNA, 15 bp, Homo sapiens
tttcttttattttta

SEQ ID NO: 778 - DNA, 15 bp, Homo sapiens
ttcttttatttttaa

SEQ ID NO: 779 - DNA, 15 bp, Homo sapiens
tcttttatttttaat

SEQ ID NO: 780 - DNA, 15 bp, Homo sapiens
cttttatttttaatt

SEQ ID NO: 781 - DNA, 15 bp, Homo sapiens
ttttatttttaattg

SEQ ID NO: 782 - DNA, 15 bp, Homo sapiens
tttatttttaattga

SEQ ID NO: 783 - DNA, 15 bp, Homo sapiens
ttatttttaattgat

SEQ ID NO: 784 - DNA, 15 bp, Homo sapiens
tatttttaattgata

SEQ ID NO: 785 - DNA, 15 bp, Homo sapiens
atttttaattgatac

SEQ ID NO: 786 - DNA, 15 bp, Homo sapiens
tttttaattgataca

SEQ ID NO: 787 - DNA, 15 bp, Homo sapiens
ttttaattgatacat

SEQ ID NO: 788 - DNA, 15 bp, Homo sapiens
tttaattgatacata

SEQ ID NO: 789 - DNA, 15 bp, Homo sapiens
ttaattgatacataa

SEQ ID NO: 790 - DNA, 15 bp, Homo sapiens
taattgatacataat

SEQ ID NO: 791 - DNA, 15 bp, Homo sapiens
aattgatacataatc

SEQ ID NO: 792 - DNA, 15 bp, Homo sapiens
attgatacataatca

SEQ ID NO: 793 - DNA, 15 bp, Homo sapiens
ttgatacataatcat

SEQ ID NO: 794 - DNA, 15 bp, Homo sapiens
tgatacataatcatt

SEQ ID NO: 795 - DNA, 15 bp, Homo sapiens
gatacataatcatta

SEQ ID NO: 796 - DNA, 15 bp, Homo sapiens
atacataatcattat

SEQ ID NO: 797 - DNA, 15 bp, Homo sapiens
tacataatcattata

SEQ ID NO: 798 - DNA, 15 bp, Homo sapiens
acataatcattatac

SEQ ID NO: 799 - DNA, 15 bp, Homo sapiens
cataatcattataca

SEQ ID NO: 800 - DNA, 15 bp, Homo sapiens
ataatcattatacat

SEQ ID NO: 801 - DNA, 15 bp, Homo sapiens
taatcattatacata

SEQ ID NO: 802 - DNA, 15 bp, Homo sapiens
aatcattatacatat

SEQ ID NO: 803 - DNA, 15 bp, Homo sapiens
atcattatacatatt

SEQ ID NO: 804 - DNA, 15 bp, Homo sapiens
tcattatacatattt

SEQ ID NO: 805 - DNA, 15 bp, Homo sapiens
cattatacatattta

SEQ ID NO: 806 - DNA, 15 bp, Homo sapiens
attatacatatttat

SEQ ID NO: 807 - DNA, 15 bp, Homo sapiens
ttatacatatttatg

SEQ ID NO: 808 - DNA, 15 bp, Homo sapiens
tatacatatttatgg

SEQ ID NO: 809 - DNA, 15 bp, Homo sapiens
atacatatttatggg

SEQ ID NO: 810 - DNA, 15 bp, Homo sapiens
tacatatttatgggt

SEQ ID NO: 811 - DNA, 15 bp, Homo sapiens
acatatttatgggtt

SEQ ID NO: 812 - DNA, 15 bp, Homo sapiens
catatttatgggtta

SEQ ID NO: 813 - DNA, 15 bp, Homo sapiens
atatttatgggttaa

SEQ ID NO: 814 - DNA, 15 bp, Homo sapiens
tatttatgggttaaa

SEQ ID NO: 815 - DNA, 15 bp, Homo sapiens
atttatgggttaaag

SEQ ID NO: 816 - DNA, 15 bp, Homo sapiens
tttatgggttaaagt

SEQ ID NO: 817 - DNA, 15 bp, Homo sapiens
ttatgggttaaagtg

SEQ ID NO: 818 - DNA, 15 bp, Homo sapiens
tatgggttaaagtgt

SEQ ID NO: 819 - DNA, 15 bp, Homo sapiens
atgggttaaagtgta

SEQ ID NO: 820 - DNA, 15 bp, Homo sapiens
tgggttaaagtgtaa

SEQ ID NO: 821 - DNA, 15 bp, Homo sapiens
gggttaaagtgtaat

SEQ ID NO: 822 - DNA, 15 bp, Homo sapiens
ggttaaagtgtaatg

SEQ ID NO: 823 - DNA, 15 bp, Homo sapiens
gttaaagtgtaatgt

SEQ ID NO: 824 - DNA, 15 bp, Homo sapiens
ttaaagtgtaatgtt

SEQ ID NO: 825 - DNA, 15 bp, Homo sapiens
taaagtgtaatgttt

SEQ ID NO: 826 - DNA, 15 bp, Homo sapiens
aaagtgtaatgtttt

SEQ ID NO: 827 - DNA, 15 bp, Homo sapiens
aagtgtaatgtttta

SEQ ID NO: 828 - DNA, 15 bp, Homo sapiens
agtgtaatgttttaa

SEQ ID NO: 829 - DNA, 15 bp, Homo sapiens
gtgtaatgttttaat

SEQ ID NO: 830 - DNA, 15 bp, Homo sapiens
tgtaatgttttaata

SEQ ID NO: 831 - DNA, 15 bp, Homo sapiens
gtaatgttttaatat

SEQ ID NO: 832 - DNA, 15 bp, Homo sapiens
taatgttttaatatg

SEQ ID NO: 833 - DNA, 15 bp, Homo sapiens
aatgttttaatatgt

SEQ ID NO: 834 - DNA, 15 bp, Homo sapiens
atgttttaatatgtg

SEQ ID NO: 835 - DNA, 15 bp, Homo sapiens
tgttttaatatgtgt

SEQ ID NO: 836 - DNA, 15 bp, Homo sapiens
gttttaatatgtgta

SEQ ID NO: 837 - DNA, 15 bp, Homo sapiens
ttttaatatgtgtac

SEQ ID NO: 838 - DNA, 15 bp, Homo sapiens
tttaatatgtgtaca

SEQ ID NO: 839 - DNA, 15 bp, Homo sapiens
ttaatatgtgtacac

SEQ ID NO: 840 - DNA, 15 bp, Homo sapiens
taatatgtgtacaca

SEQ ID NO: 841 - DNA, 15 bp, Homo sapiens
aatatgtgtacacat

SEQ ID NO: 842 - DNA, 15 bp, Homo sapiens
atatgtgtacacata

SEQ ID NO: 843 - DNA, 15 bp, Homo sapiens
tatgtgtacacatat

SEQ ID NO: 844 - DNA, 15 bp, Homo sapiens
atgtgtacacatatt

SEQ ID NO: 845 - DNA, 15 bp, Homo sapiens
tgtgtacacatattg

SEQ ID NO: 846 - DNA, 15 bp, Homo sapiens
gtgtacacatattga

SEQ ID NO: 847 - DNA, 15 bp, Homo sapiens
tgtacacatattgac

SEQ ID NO: 848 - DNA, 15 bp, Homo sapiens
gtacacatattgacc

SEQ ID NO: 849 - DNA, 15 bp, Homo sapiens
tacacatattgacca

SEQ ID NO: 850 - DNA, 15 bp, Homo sapiens
acacatattgaccaa

SEQ ID NO: 851 - DNA, 15 bp, Homo sapiens
cacatattgaccaaa

SEQ ID NO: 852 - DNA, 15 bp, Homo sapiens
acatattgaccaaat

SEQ ID NO: 853 - DNA, 15 bp, Homo sapiens
catattgaccaaatc

SEQ ID NO: 854 - DNA, 15 bp, Homo sapiens
atattgaccaaatca

SEQ ID NO: 855 - DNA, 15 bp, Homo sapiens
tattgaccaaatcag

SEQ ID NO: 856 - DNA, 15 bp, Homo sapiens
attgaccaaatcagg

SEQ ID NO: 857 - DNA, 15 bp, Homo sapiens
ttgaccaaatcaggg

SEQ ID NO: 858 - DNA, 15 bp, Homo sapiens
tgaccaaatcagggt

SEQ ID NO: 859 - DNA, 15 bp, Homo sapiens
gaccaaatcagggta

SEQ ID NO: 860 - DNA, 15 bp, Homo sapiens
accaaatcagggtaa

SEQ ID NO: 861 - DNA, 15 bp, Homo sapiens
ccaaatcagggtaat

SEQ ID NO: 862 - DNA, 15 bp, Homo sapiens
caaatcagggtaatt

SEQ ID NO: 863 - DNA, 15 bp, Homo sapiens
aaatcagggtaattt

SEQ ID NO: 864 - DNA, 15 bp, Homo sapiens
aatcagggtaatttt

SEQ ID NO: 865 - DNA, 15 bp, Homo sapiens
atcagggtaattttg

SEQ ID NO: 866 - DNA, 15 bp, Homo sapiens
tcagggtaattttgc

SEQ ID NO: 867 - DNA, 15 bp, Homo sapiens
cagggtaattttgca

SEQ ID NO: 868 - DNA, 15 bp, Homo sapiens
agggtaattttgcat

SEQ ID NO: 869 - DNA, 15 bp, Homo sapiens
gggtaattttgcatt

SEQ ID NO: 870 - DNA, 15 bp, Homo sapiens
ggtaattttgcattt

SEQ ID NO: 871 - DNA, 15 bp, Homo sapiens
gtaattttgcatttg

SEQ ID NO: 872 - DNA, 15 bp, Homo sapiens
taattttgcatttgt

SEQ ID NO: 873 - DNA, 15 bp, Homo sapiens
aattttgcatttgta

SEQ ID NO: 874 - DNA, 15 bp, Homo sapiens
attttgcatttgtaa

SEQ ID NO: 875 - DNA, 15 bp, Homo sapiens
ttttgcatttgtaat

SEQ ID NO: 876 - DNA, 15 bp, Homo sapiens
tttgcatttgtaatt

SEQ ID NO: 877 - DNA, 15 bp, Homo sapiens
ttgcatttgtaattt

SEQ ID NO: 878 - DNA, 15 bp, Homo sapiens
tgcatttgtaatttt

SEQ ID NO: 879 - DNA, 15 bp, Homo sapiens
gcatttgtaatttta

SEQ ID NO: 880 - DNA, 15 bp, Homo sapiens
catttgtaattttaa

SEQ ID NO: 881 - DNA, 15 bp, Homo sapiens
atttgtaattttaaa

SEQ ID NO: 882 - DNA, 15 bp, Homo sapiens
tttgtaattttaaaa

SEQ ID NO: 883 - DNA, 15 bp, Homo sapiens
ttgtaattttaaaaa

SEQ ID NO: 884 - DNA, 15 bp, Homo sapiens
tgtaattttaaaaaa

SEQ ID NO: 885 - DNA, 15 bp, Homo sapiens
gtaattttaaaaaat

SEQ ID NO: 886 - DNA, 15 bp, Homo sapiens
taattttaaaaaatg

SEQ ID NO: 887 - DNA, 15 bp, Homo sapiens
aattttaaaaaatgc

SEQ ID NO: 888 - DNA, 15 bp, Homo sapiens
attttaaaaaatgct

SEQ ID NO: 889 - DNA, 15 bp, Homo sapiens
ttttaaaaaatgctt

SEQ ID NO: 890 - DNA, 15 bp, Homo sapiens
tttaaaaaatgcttt

SEQ ID NO: 891 - DNA, 15 bp, Homo sapiens
ttaaaaaatgctttc

SEQ ID NO: 892 - DNA, 15 bp, Homo sapiens
taaaaaatgctttct

SEQ ID NO: 893 - DNA, 15 bp, Homo sapiens
aaaaaatgctttctt

SEQ ID NO: 894 - DNA, 15 bp, Homo sapiens
aaaaatgctttcttc

SEQ ID NO: 895 - DNA, 15 bp, Homo sapiens
aaaatgctttcttct

SEQ ID NO: 896 - DNA, 15 bp, Homo sapiens
aaatgctttcttctt

SEQ ID NO: 897 - DNA, 15 bp, Homo sapiens
aatgctttcttcttt

SEQ ID NO: 898 - DNA, 15 bp, Homo sapiens
atgctttcttctttt

SEQ ID NO: 899 - DNA, 15 bp, Homo sapiens
tgctttcttctttta

SEQ ID NO: 900 - DNA, 15 bp, Homo sapiens
gctttcttcttttaa

SEQ ID NO: 901 - DNA, 15 bp, Homo sapiens
ctttcttcttttaat

SEQ ID NO: 902 - DNA, 15 bp, Homo sapiens
tttcttcttttaata

SEQ ID NO: 903 - DNA, 15 bp, Homo sapiens
ttcttcttttaatat

SEQ ID NO: 904 - DNA, 15 bp, Homo sapiens
tcttcttttaatata

SEQ ID NO: 905 - DNA, 15 bp, Homo sapiens
cttcttttaatatac

SEQ ID NO: 906 - DNA, 15 bp, Homo sapiens
ttcttttaatatact

SEQ ID NO: 907 - DNA, 15 bp, Homo sapiens
tcttttaatatactt

SEQ ID NO: 908 - DNA, 15 bp, Homo sapiens
cttttaatatacttt

SEQ ID NO: 909 - DNA, 15 bp, Homo sapiens
ttttaatatactttt

SEQ ID NO: 910 - DNA, 15 bp, Homo sapiens
tttaatatacttttt

SEQ ID NO: 911 - DNA, 15 bp, Homo sapiens
ttaatatactttttt

SEQ ID NO: 912 - DNA, 15 bp, Homo sapiens
taatatacttttttg

SEQ ID NO: 913 - DNA, 15 bp, Homo sapiens
aatatacttttttgt

SEQ ID NO: 914 - DNA, 15 bp, Homo sapiens
atatacttttttgtt

SEQ ID NO: 915 - DNA, 15 bp, Homo sapiens
tatacttttttgttt

SEQ ID NO: 916 - DNA, 15 bp, Homo sapiens
atacttttttgttta

SEQ ID NO: 917 - DNA, 15 bp, Homo sapiens
tacttttttgtttat

SEQ ID NO: 918 - DNA, 15 bp, Homo sapiens
acttttttgtttatc

SEQ ID NO: 919 - DNA, 15 bp, Homo sapiens
cttttttgtttatct

SEQ ID NO: 920 - DNA, 15 bp, Homo sapiens
ttttttgtttatctt

SEQ ID NO: 921 - DNA, 15 bp, Homo sapiens
tttttgtttatctta

SEQ ID NO: 922 - DNA, 15 bp, Homo sapiens
ttttgtttatcttat

SEQ ID NO: 923 - DNA, 15 bp, Homo sapiens
tttgtttatcttatt

SEQ ID NO: 924 - DNA, 15 bp, Homo sapiens
ttgtttatcttattt

SEQ ID NO: 925 - DNA, 15 bp, Homo sapiens
tgtttatcttatttc

SEQ ID NO: 926 - DNA, 15 bp, Homo sapiens
gtttatcttatttct

SEQ ID NO: 927 - DNA, 15 bp, Homo sapiens
tttatcttatttcta

SEQ ID NO: 928 - DNA, 15 bp, Homo sapiens
ttatcttatttctaa

SEQ ID NO: 929 - DNA, 15 bp, Homo sapiens
tatcttatttctaat

SEQ ID NO: 930 - DNA, 15 bp, Homo sapiens
atcttatttctaata

SEQ ID NO: 931 - DNA, 15 bp, Homo sapiens
tcttatttctaatac

SEQ ID NO: 932 - DNA, 15 bp, Homo sapiens
cttatttctaatact

SEQ ID NO: 933 - DNA, 15 bp, Homo sapiens
ttatttctaatactt

SEQ ID NO: 934 - DNA, 15 bp, Homo sapiens
tatttctaatacttt

SEQ ID NO: 935 - DNA, 15 bp, Homo sapiens
atttctaatactttc

SEQ ID NO: 936 - DNA, 15 bp, Homo sapiens
tttctaatactttcc

SEQ ID NO: 937 - DNA, 15 bp, Homo sapiens
ttctaatactttccc

SEQ ID NO: 938 - DNA, 15 bp, Homo sapiens
tctaatactttccct

SEQ ID NO: 939 - DNA, 15 bp, Homo sapiens
ctaatactttcccta

SEQ ID NO: 940 - DNA, 15 bp, Homo sapiens
taatactttccctaa

SEQ ID NO: 941 - DNA, 15 bp, Homo sapiens
aatactttccctaat

SEQ ID NO: 942 - DNA, 15 bp, Homo sapiens
atactttccctaatc

SEQ ID NO: 943 - DNA, 15 bp, Homo sapiens
tactttccctaatct

SEQ ID NO: 944 - DNA, 15 bp, Homo sapiens
actttccctaatctc

SEQ ID NO: 945 - DNA, 15 bp, Homo sapiens
ctttccctaatctct

SEQ ID NO: 946 - DNA, 15 bp, Homo sapiens
tttccctaatctctt

SEQ ID NO: 947 - DNA, 15 bp, Homo sapiens
ttccctaatctcttt

SEQ ID NO: 948 - DNA, 15 bp, Homo sapiens
tccctaatctctttc

SEQ ID NO: 949 - DNA, 15 bp, Homo sapiens
ccctaatctctttct

SEQ ID NO: 950 - DNA, 15 bp, Homo sapiens
cctaatctctttctt

SEQ ID NO: 951 - DNA, 15 bp, Homo sapiens
ctaatctctttcttt

SEQ ID NO: 952 - DNA, 15 bp, Homo sapiens
taatctctttctttc

SEQ ID NO: 953 - DNA, 15 bp, Homo sapiens
aatctctttctttca

SEQ ID NO: 954 - DNA, 15 bp, Homo sapiens
atctctttctttcag

SEQ ID NO: 955 - DNA, 15 bp, Homo sapiens
tctctttctttcagg

SEQ ID NO: 956 - DNA, 15 bp, Homo sapiens
ctctttctttcaggg

SEQ ID NO: 957 - DNA, 15 bp, Homo sapiens
tctttctttcagggc

SEQ ID NO: 958 - DNA, 15 bp, Homo sapiens
ctttctttcagggca

SEQ ID NO: 959 - DNA, 15 bp, Homo sapiens
tttctttcagggcaa

SEQ ID NO: 960 - DNA, 15 bp, Homo sapiens
ttctttcagggcaat

SEQ ID NO: 961 - DNA, 15 bp, Homo sapiens
tctttcagggcaata

SEQ ID NO: 962 - DNA, 15 bp, Homo sapiens
ctttcagggcaataa

SEQ ID NO: 963 - DNA, 15 bp, Homo sapiens
tttcagggcaataat

SEQ ID NO: 964 - DNA, 15 bp, Homo sapiens
ttcagggcaataatg

SEQ ID NO: 965 - DNA, 15 bp, Homo sapiens
tcagggcaataatga

SEQ ID NO: 966 - DNA, 15 bp, Homo sapiens
cagggcaataatgat

SEQ ID NO: 967 - DNA, 15 bp, Homo sapiens
agggcaataatgata

SEQ ID NO: 968 - DNA, 15 bp, Homo sapiens
gggcaataatgatac

SEQ ID NO: 969 - DNA, 15 bp, Homo sapiens
ggcaataatgataca

SEQ ID NO: 970 - DNA, 15 bp, Homo sapiens
gcaataatgatacaa

SEQ ID NO: 971 - DNA, 15 bp, Homo sapiens
caataatgatacaat

SEQ ID NO: 972 - DNA, 15 bp, Homo sapiens
aataatgatacaatg

SEQ ID NO: 973 - DNA, 15 bp, Homo sapiens
ataatgatacaatgt

SEQ ID NO: 974 - DNA, 15 bp, Homo sapiens
taatgatacaatgta

SEQ ID NO: 975 - DNA, 15 bp, Homo sapiens
aatgatacaatgtat

SEQ ID NO: 976 - DNA, 15 bp, Homo sapiens
atgatacaatgtatc

SEQ ID NO: 977 - DNA, 15 bp, Homo sapiens
tgatacaatgtatca

SEQ ID NO: 978 - DNA, 15 bp, Homo sapiens
gatacaatgtatcat

SEQ ID NO: 979 - DNA, 15 bp, Homo sapiens
atacaatgtatcatg

SEQ ID NO: 980 - DNA, 15 bp, Homo sapiens
tacaatgtatcatgc

SEQ ID NO: 981 - DNA, 15 bp, Homo sapiens
acaatgtatcatgcc

SEQ ID NO: 982 - DNA, 15 bp, Homo sapiens
caatgtatcatgcct

SEQ ID NO: 983 - DNA, 15 bp, Homo sapiens
aatgtatcatgcctc

SEQ ID NO: 984 - DNA, 15 bp, Homo sapiens
atgtatcatgcctct

SEQ ID NO: 985 - DNA, 15 bp, Homo sapiens
tgtatcatgcctctt

SEQ ID NO: 986 - DNA, 15 bp, Homo sapiens
gtatcatgcctcttt

SEQ ID NO: 987 - DNA, 15 bp, Homo sapiens
tatcatgcctctttg

SEQ ID NO: 988 - DNA, 15 bp, Homo sapiens
atcatgcctctttgc

SEQ ID NO: 989 - DNA, 15 bp, Homo sapiens
tcatgcctctttgca

SEQ ID NO: 990 - DNA, 15 bp, Homo sapiens
catgcctctttgcac

SEQ ID NO: 991 - DNA, 15 bp, Homo sapiens
atgcctctttgcacc

SEQ ID NO: 992 - DNA, 15 bp, Homo sapiens
tgcctctttgcacca

SEQ ID NO: 993 - DNA, 15 bp, Homo sapiens
gcctctttgcaccat

SEQ ID NO: 994 - DNA, 15 bp, Homo sapiens
cctctttgcaccatt

SEQ ID NO: 995 - DNA, 15 bp, Homo sapiens
ctctttgcaccattc

SEQ ID NO: 996 - DNA, 15 bp, Homo sapiens
tctttgcaccattct

SEQ ID NO: 997 - DNA, 15 bp, Homo sapiens
ctttgcaccattcta

SEQ ID NO: 998 - DNA, 15 bp, Homo sapiens
tttgcaccattctaa

SEQ ID NO: 999 - DNA, 15 bp, Homo sapiens
ttgcaccattctaaa

SEQ ID NO: 1000 - DNA, 15 bp, Homo sapiens
tgcaccattctaaag

SEQ ID NO: 1001 - DNA, 15 bp, Homo sapiens
gcaccattctaaaga

SEQ ID NO: 1002 - DNA, 15 bp, Homo sapiens
caccattctaaagaa

SEQ ID NO: 1003 - DNA, 15 bp, Homo sapiens
accattctaaagaat

SEQ ID NO: 1004 - DNA, 15 bp, Homo sapiens
ccattctaaagaata

SEQ ID NO: 1005 - DNA, 15 bp, Homo sapiens
cattctaaagaataa

SEQ ID NO: 1006 - DNA, 15 bp, Homo sapiens
attctaaagaataac

SEQ ID NO: 1007 - DNA, 15 bp, Homo sapiens
ttctaaagaataaca

SEQ ID NO: 1008 - DNA, 15 bp, Homo sapiens
tctaaagaataacag

SEQ ID NO: 1009 - DNA, 15 bp, Homo sapiens
ctaaagaataacagt

SEQ ID NO: 1010 - DNA, 15 bp, Homo sapiens
taaagaataacagtg

SEQ ID NO: 1011 - DNA, 15 bp, Homo sapiens
aaagaataacagtga

SEQ ID NO: 1012 - DNA, 15 bp, Homo sapiens
aagaataacagtgat

SEQ ID NO: 1013 - DNA, 15 bp, Homo sapiens
agaataacagtgata

SEQ ID NO: 1014 - DNA, 15 bp, Homo sapiens
gaataacagtgataa

SEQ ID NO: 1015 - DNA, 15 bp, Homo sapiens
aataacagtgataat

SEQ ID NO: 1016 - DNA, 15 bp, Homo sapiens
ataacagtgataatt

SEQ ID NO: 1017 - DNA, 15 bp, Homo sapiens
taacagtgataattt

SEQ ID NO: 1018 - DNA, 15 bp, Homo sapiens
aacagtgataatttc

SEQ ID NO: 1019 - DNA, 15 bp, Homo sapiens
acagtgataatttct

SEQ ID NO: 1020 - DNA, 15 bp, Homo sapiens
cagtgataatttctg

SEQ ID NO: 1021 - DNA, 15 bp, Homo sapiens
agtgataatttctgg

SEQ ID NO: 1022 - DNA, 15 bp, Homo sapiens
gtgataatttctggg

SEQ ID NO: 1023 - DNA, 15 bp, Homo sapiens
tgataatttctgggt

SEQ ID NO: 1024 - DNA, 15 bp, Homo sapiens
gataatttctgggtt

SEQ ID NO: 1025 - DNA, 15 bp, Homo sapiens
ataatttctgggtta

SEQ ID NO: 1026 - DNA, 15 bp, Homo sapiens
taatttctgggttaa

SEQ ID NO: 1027 - DNA, 15 bp, Homo sapiens
aatttctgggttaag

SEQ ID NO: 1028 - DNA, 15 bp, Homo sapiens
atttctgggttaagg

SEQ ID NO: 1029 - DNA, 15 bp, Homo sapiens
tttctgggttaaggc

SEQ ID NO: 1030 - DNA, 15 bp, Homo sapiens
ttctgggttaaggca

SEQ ID NO: 1031 - DNA, 15 bp, Homo sapiens
tctgggttaaggcaa

SEQ ID NO: 1032 - DNA, 15 bp, Homo sapiens
ctgggttaaggcaat

SEQ ID NO: 1033 - DNA, 15 bp, Homo sapiens
tgggttaaggcaata

SEQ ID NO: 1034 - DNA, 15 bp, Homo sapiens
gggttaaggcaatag

SEQ ID NO: 1035 - DNA, 15 bp, Homo sapiens
ggttaaggcaatagc

SEQ ID NO: 1036 - DNA, 15 bp, Homo sapiens
gttaaggcaatagca

SEQ ID NO: 1037 - DNA, 15 bp, Homo sapiens
ttaaggcaatagcaa

SEQ ID NO: 1038 - DNA, 15 bp, Homo sapiens
taaggcaatagcaat

SEQ ID NO: 1039 - DNA, 15 bp, Homo sapiens
aaggcaatagcaata

SEQ ID NO: 1040 - DNA, 15 bp, Homo sapiens
aggcaatagcaatat

SEQ ID NO: 1041 - DNA, 15 bp, Homo sapiens
ggcaatagcaatatc

SEQ ID NO: 1042 - DNA, 15 bp, Homo sapiens
gcaatagcaatatct

SEQ ID NO: 1043 - DNA, 15 bp, Homo sapiens
caatagcaatatctc

SEQ ID NO: 1044 - DNA, 15 bp, Homo sapiens
aatagcaatatctct

SEQ ID NO: 1045 - DNA, 15 bp, Homo sapiens
atagcaatatctctg

SEQ ID NO: 1046 - DNA, 15 bp, Homo sapiens
tagcaatatctctgc

SEQ ID NO: 1047 - DNA, 15 bp, Homo sapiens
agcaatatctctgca

SEQ ID NO: 1048 - DNA, 15 bp, Homo sapiens
gcaatatctctgcat

SEQ ID NO: 1049 - DNA, 15 bp, Homo sapiens
caatatctctgcata

SEQ ID NO: 1050 - DNA, 15 bp, Homo sapiens
aatatctctgcatat

SEQ ID NO: 1051 - DNA, 15 bp, Homo sapiens
atatctctgcatata

SEQ ID NO: 1052 - DNA, 15 bp, Homo sapiens
tatctctgcatataa

SEQ ID NO: 1053 - DNA, 15 bp, Homo sapiens
atctctgcatataaa

SEQ ID NO: 1054 - DNA, 15 bp, Homo sapiens
tctctgcatataaat

SEQ ID NO: 1055 - DNA, 15 bp, Homo sapiens
ctctgcatataaata

SEQ ID NO: 1056 - DNA, 15 bp, Homo sapiens
tctgcatataaatat

SEQ ID NO: 1057 - DNA, 15 bp, Homo sapiens
ctgcatataaatatt

SEQ ID NO: 1058 - DNA, 15 bp, Homo sapiens
tgcatataaatattt

SEQ ID NO: 1059 - DNA, 15 bp, Homo sapiens
gcatataaatatttc

SEQ ID NO: 1060 - DNA, 15 bp, Homo sapiens
catataaatatttct

SEQ ID NO: 1061 - DNA, 15 bp, Homo sapiens
atataaatatttctg

SEQ ID NO: 1062 - DNA, 15 bp, Homo sapiens
tataaatatttctgc

SEQ ID NO: 1063 - DNA, 15 bp, Homo sapiens
ataaatatttctgca

SEQ ID NO: 1064 - DNA, 15 bp, Homo sapiens
taaatatttctgcat

SEQ ID NO: 1065 - DNA, 15 bp, Homo sapiens
aaatatttctgcata

SEQ ID NO: 1066 - DNA, 15 bp, Homo sapiens
aatatttctgcatat

SEQ ID NO: 1067 - DNA, 15 bp, Homo sapiens
atatttctgcatata

SEQ ID NO: 1068 - DNA, 15 bp, Homo sapiens
tatttctgcatataa

SEQ ID NO: 1069 - DNA, 15 bp, Homo sapiens
atttctgcatataaa

SEQ ID NO: 1070 - DNA, 15 bp, Homo sapiens
tttctgcatataaat

SEQ ID NO: 1071 - DNA, 15 bp, Homo sapiens
ttctgcatataaatt

SEQ ID NO: 1072 - DNA, 15 bp, Homo sapiens
tctgcatataaattg

SEQ ID NO: 1073 - DNA, 15 bp, Homo sapiens
ctgcatataaattgt

SEQ ID NO: 1074 - DNA, 15 bp, Homo sapiens
tgcatataaattgta

SEQ ID NO: 1075 - DNA, 15 bp, Homo sapiens
gcatataaattgtaa

SEQ ID NO: 1076 - DNA, 15 bp, Homo sapiens
catataaattgtaac

SEQ ID NO: 1077 - DNA, 15 bp, Homo sapiens
atataaattgtaact

SEQ ID NO: 1078 - DNA, 15 bp, Homo sapiens
tataaattgtaactg

SEQ ID NO: 1079 - DNA, 15 bp, Homo sapiens
ataaattgtaactga

SEQ ID NO: 1080 - DNA, 15 bp, Homo sapiens
taaattgtaactgat

SEQ ID NO: 1081 - DNA, 15 bp, Homo sapiens
aaattgtaactgatg

SEQ ID NO: 1082 - DNA, 15 bp, Homo sapiens
aattgtaactgatgt

SEQ ID NO: 1083 - DNA, 15 bp, Homo sapiens
attgtaactgatgta

SEQ ID NO: 1084 - DNA, 15 bp, Homo sapiens
ttgtaactgatgtaa

SEQ ID NO: 1085 - DNA, 15 bp, Homo sapiens
tgtaactgatgtaag

SEQ ID NO: 1086 - DNA, 15 bp, Homo sapiens
gtaactgatgtaaga

SEQ ID NO: 1087 - DNA, 15 bp, Homo sapiens
taactgatgtaagag

SEQ ID NO: 1088 - DNA, 15 bp, Homo sapiens
aactgatgtaagagg

SEQ ID NO: 1089 - DNA, 15 bp, Homo sapiens
actgatgtaagaggt

SEQ ID NO: 1090 - DNA, 15 bp, Homo sapiens
ctgatgtaagaggtt

SEQ ID NO: 1091 - DNA, 15 bp, Homo sapiens
tgatgtaagaggttt

SEQ ID NO: 1092 - DNA, 15 bp, Homo sapiens
gatgtaagaggtttc

SEQ ID NO: 1093 - DNA, 15 bp, Homo sapiens
atgtaagaggtttca

SEQ ID NO: 1094 - DNA, 15 bp, Homo sapiens
tgtaagaggtttcat

SEQ ID NO: 1095 - DNA, 15 bp, Homo sapiens
gtaagaggtttcata

SEQ ID NO: 1096 - DNA, 15 bp, Homo sapiens
taagaggtttcatat

SEQ ID NO: 1097 - DNA, 15 bp, Homo sapiens
aagaggtttcatatt

SEQ ID NO: 1098 - DNA, 15 bp, Homo sapiens
agaggtttcatattg

SEQ ID NO: 1099 - DNA, 15 bp, Homo sapiens
gaggtttcatattgc

SEQ ID NO: 1100 - DNA, 15 bp, Homo sapiens
aggtttcatattgct

SEQ ID NO: 1101 - DNA, 15 bp, Homo sapiens
ggtttcatattgcta

SEQ ID NO: 1102 - DNA, 15 bp, Homo sapiens
gtttcatattgctaa

SEQ ID NO: 1103 - DNA, 15 bp, Homo sapiens
tttcatattgctaat

SEQ ID NO: 1104 - DNA, 15 bp, Homo sapiens
ttcatattgctaata

SEQ ID NO: 1105 - DNA, 15 bp, Homo sapiens
tcatattgctaatag

SEQ ID NO: 1106 - DNA, 15 bp, Homo sapiens
catattgctaatagc

SEQ ID NO: 1107 - DNA, 15 bp, Homo sapiens
atattgctaatagca

SEQ ID NO: 1108 - DNA, 15 bp, Homo sapiens
tattgctaatagcag

SEQ ID NO: 1109 - DNA, 15 bp, Homo sapiens
attgctaatagcagc

SEQ ID NO: 1110 - DNA, 15 bp, Homo sapiens
ttgctaatagcagct

SEQ ID NO: 1111 - DNA, 15 bp, Homo sapiens
tgctaatagcagcta

SEQ ID NO: 1112 - DNA, 15 bp, Homo sapiens
gctaatagcagctac

SEQ ID NO: 1113 - DNA, 15 bp, Homo sapiens
ctaatagcagctaca

SEQ ID NO: 1114 - DNA, 15 bp, Homo sapiens
taatagcagctacaa

SEQ ID NO: 1115 - DNA, 15 bp, Homo sapiens
aatagcagctacaat

SEQ ID NO: 1116 - DNA, 15 bp, Homo sapiens
atagcagctacaatc

SEQ ID NO: 1117 - DNA, 15 bp, Homo sapiens
tagcagctacaatcc

SEQ ID NO: 1118 - DNA, 15 bp, Homo sapiens
agcagctacaatcca

SEQ ID NO: 1119 - DNA, 15 bp, Homo sapiens
gcagctacaatccag

SEQ ID NO: 1120 - DNA, 15 bp, Homo sapiens
cagctacaatccagc

SEQ ID NO: 1121 - DNA, 15 bp, Homo sapiens
agctacaatccagct

SEQ ID NO: 1122 - DNA, 15 bp, Homo sapiens
gctacaatccagcta

SEQ ID NO: 1123 - DNA, 15 bp, Homo sapiens
ctacaatccagctac

SEQ ID NO: 1124 - DNA, 15 bp, Homo sapiens
tacaatccagctacc

SEQ ID NO: 1125 - DNA, 15 bp, Homo sapiens
acaatccagctacca

SEQ ID NO: 1126 - DNA, 15 bp, Homo sapiens
caatccagctaccat

SEQ ID NO: 1127 - DNA, 15 bp, Homo sapiens
aatccagctaccatt

SEQ ID NO: 1128 - DNA, 15 bp, Homo sapiens
atccagctaccattc

SEQ ID NO: 1129 - DNA, 15 bp, Homo sapiens
tccagctaccattct

SEQ ID NO: 1130 - DNA, 15 bp, Homo sapiens
ccagctaccattctg

SEQ ID NO: 1131 - DNA, 15 bp, Homo sapiens
cagctaccattctgc

SEQ ID NO: 1132 - DNA, 15 bp, Homo sapiens
agctaccattctgct

SEQ ID NO: 1133 - DNA, 15 bp, Homo sapiens
gctaccattctgctt

SEQ ID NO: 1134 - DNA, 15 bp, Homo sapiens
ctaccattctgcttt

SEQ ID NO: 1135 - DNA, 15 bp, Homo sapiens
taccattctgctttt

SEQ ID NO: 1136 - DNA, 15 bp, Homo sapiens
accattctgctttta

SEQ ID NO: 1137 - DNA, 15 bp, Homo sapiens
ccattctgcttttat

SEQ ID NO: 1138 - DNA, 15 bp, Homo sapiens
cattctgcttttatt

SEQ ID NO: 1139 - DNA, 15 bp, Homo sapiens
attctgcttttattt

SEQ ID NO: 1140 - DNA, 15 bp, Homo sapiens
ttctgcttttatttt

SEQ ID NO: 1141 - DNA, 15 bp, Homo sapiens
tctgcttttatttta

SEQ ID NO: 1142 - DNA, 15 bp, Homo sapiens
ctgcttttattttat

SEQ ID NO: 1143 - DNA, 15 bp, Homo sapiens
tgcttttattttatg

SEQ ID NO: 1144 - DNA, 15 bp, Homo sapiens
gcttttattttatgg

SEQ ID NO: 1145 - DNA, 15 bp, Homo sapiens
cttttattttatggt

SEQ ID NO: 1146 - DNA, 15 bp, Homo sapiens
ttttattttatggtt

SEQ ID NO: 1147 - DNA, 15 bp, Homo sapiens
tttattttatggttg

SEQ ID NO: 1148 - DNA, 15 bp, Homo sapiens
ttattttatggttgg

SEQ ID NO: 1149 - DNA, 15 bp, Homo sapiens
tattttatggttggg

SEQ ID NO: 1150 - DNA, 15 bp, Homo sapiens
attttatggttggga

SEQ ID NO: 1151 - DNA, 15 bp, Homo sapiens
ttttatggttgggat

SEQ ID NO: 1152 - DNA, 15 bp, Homo sapiens
tttatggttgggata

SEQ ID NO: 1153 - DNA, 15 bp, Homo sapiens
ttatggttgggataa

SEQ ID NO: 1154 - DNA, 15 bp, Homo sapiens
tatggttgggataag

SEQ ID NO: 1155 - DNA, 15 bp, Homo sapiens
atggttgggataagg

SEQ ID NO: 1156 - DNA, 15 bp, Homo sapiens
tggttgggataaggc

SEQ ID NO: 1157 - DNA, 15 bp, Homo sapiens
ggttgggataaggct

SEQ ID NO: 1158 - DNA, 15 bp, Homo sapiens
gttgggataaggctg

SEQ ID NO: 1159 - DNA, 15 bp, Homo sapiens
ttgggataaggctgg

SEQ ID NO: 1160 - DNA, 15 bp, Homo sapiens
tgggataaggctgga

SEQ ID NO: 1161 - DNA, 15 bp, Homo sapiens
gggataaggctggat

SEQ ID NO: 1162 - DNA, 15 bp, Homo sapiens
ggataaggctggatt

SEQ ID NO: 1163 - DNA, 15 bp, Homo sapiens
gataaggctggatta

SEQ ID NO: 1164 - DNA, 15 bp, Homo sapiens
ataaggctggattat

SEQ ID NO: 1165 - DNA, 15 bp, Homo sapiens
taaggctggattatt

SEQ ID NO: 1166 - DNA, 15 bp, Homo sapiens
aaggctggattattc

SEQ ID NO: 1167 - DNA, 15 bp, Homo sapiens
aggctggattattct

SEQ ID NO: 1168 - DNA, 15 bp, Homo sapiens
ggctggattattctg

SEQ ID NO: 1169 - DNA, 15 bp, Homo sapiens
gctggattattctga

SEQ ID NO: 1170 - DNA, 15 bp, Homo sapiens
ctggattattctgag

SEQ ID NO: 1171 - DNA, 15 bp, Homo sapiens
tggattattctgagt

SEQ ID NO: 1172 - DNA, 15 bp, Homo sapiens
ggattattctgagtc

SEQ ID NO: 1173 - DNA, 15 bp, Homo sapiens
gattattctgagtcc

SEQ ID NO: 1174 - DNA, 15 bp, Homo sapiens
attattctgagtcca

SEQ ID NO: 1175 - DNA, 15 bp, Homo sapiens
ttattctgagtccaa

SEQ ID NO: 1176 - DNA, 15 bp, Homo sapiens
tattctgagtccaag

SEQ ID NO: 1177 - DNA, 15 bp, Homo sapiens
attctgagtccaagc

SEQ ID NO: 1178 - DNA, 15 bp, Homo sapiens
ttctgagtccaagct

SEQ ID NO: 1179 - DNA, 15 bp, Homo sapiens
tctgagtccaagcta

SEQ ID NO: 1180 - DNA, 15 bp, Homo sapiens
ctgagtccaagctag

SEQ ID NO: 1181 - DNA, 15 bp, Homo sapiens
tgagtccaagctagg

SEQ ID NO: 1182 - DNA, 15 bp, Homo sapiens
gagtccaagctaggc

SEQ ID NO: 1183 - DNA, 15 bp, Homo sapiens
agtccaagctaggcc

SEQ ID NO: 1184 - DNA, 15 bp, Homo sapiens
gtccaagctaggccc

SEQ ID NO: 1185 - DNA, 15 bp, Homo sapiens
tccaagctaggccct

SEQ ID NO: 1186 - DNA, 15 bp, Homo sapiens
ccaagctaggccctt

SEQ ID NO: 1187 - DNA, 15 bp, Homo sapiens
caagctaggcccttt

SEQ ID NO: 1188 - DNA, 15 bp, Homo sapiens
aagctaggccctttt

SEQ ID NO: 1189 - DNA, 15 bp, Homo sapiens
agctaggcccttttg

SEQ ID NO: 1190 - DNA, 15 bp, Homo sapiens
gctaggcccttttgc

SEQ ID NO: 1191 - DNA, 15 bp, Homo sapiens
ctaggcccttttgct

SEQ ID NO: 1192 - DNA, 15 bp, Homo sapiens
taggcccttttgcta

SEQ ID NO: 1193 - DNA, 15 bp, Homo sapiens
aggcccttttgctaa

SEQ ID NO: 1194 - DNA, 15 bp, Homo sapiens
ggcccttttgctaat

SEQ ID NO: 1195 - DNA, 15 bp, Homo sapiens
gcccttttgctaatc

SEQ ID NO: 1196 - DNA, 15 bp, Homo sapiens
cccttttgctaatca

SEQ ID NO: 1197 - DNA, 15 bp, Homo sapiens
ccttttgctaatcat

SEQ ID NO: 1198 - DNA, 15 bp, Homo sapiens
cttttgctaatcatg

SEQ ID NO: 1199 - DNA, 15 bp, Homo sapiens
ttttgctaatcatgt

SEQ ID NO: 1200 - DNA, 15 bp, Homo sapiens
tttgctaatcatgtt

SEQ ID NO: 1201 - DNA, 15 bp, Homo sapiens
ttgctaatcatgttc

SEQ ID NO: 1202 - DNA, 15 bp, Homo sapiens
tgctaatcatgttca

SEQ ID NO: 1203 - DNA, 15 bp, Homo sapiens
gctaatcatgttcat

SEQ ID NO: 1204 - DNA, 15 bp, Homo sapiens
ctaatcatgttcata

SEQ ID NO: 1205 - DNA, 15 bp, Homo sapiens
taatcatgttcatac

SEQ ID NO: 1206 - DNA, 15 bp, Homo sapiens
aatcatgttcatacc

SEQ ID NO: 1207 - DNA, 15 bp, Homo sapiens
atcatgttcatacct

SEQ ID NO: 1208 - DNA, 15 bp, Homo sapiens
tcatgttcatacctc

SEQ ID NO: 1209 - DNA, 15 bp, Homo sapiens
catgttcatacctct

SEQ ID NO: 1210 - DNA, 15 bp, Homo sapiens
atgttcatacctctt

SEQ ID NO: 1211 - DNA, 15 bp, Homo sapiens
tgttcatacctctta

SEQ ID NO: 1212 - DNA, 15 bp, Homo sapiens
gttcatacctcttat

SEQ ID NO: 1213 - DNA, 15 bp, Homo sapiens
ttcatacctcttatc

SEQ ID NO: 1214 - DNA, 15 bp, Homo sapiens
tcatacctcttatct

SEQ ID NO: 1215 - DNA, 15 bp, Homo sapiens
catacctcttatctt

SEQ ID NO: 1216 - DNA, 15 bp, Homo sapiens
atacctcttatcttc

SEQ ID NO: 1217 - DNA, 15 bp, Homo sapiens
tacctcttatcttcc

SEQ ID NO: 1218 - DNA, 15 bp, Homo sapiens
acctcttatcttcct

SEQ ID NO: 1219 - DNA, 15 bp, Homo sapiens
cctcttatcttcctc

SEQ ID NO: 1220 - DNA, 15 bp, Homo sapiens
ctcttatcttcctcc

SEQ ID NO: 1221 - DNA, 15 bp, Homo sapiens
tcttatcttcctccc

SEQ ID NO: 1222 - DNA, 15 bp, Homo sapiens
cttatcttcctccca

SEQ ID NO: 1223 - DNA, 15 bp, Homo sapiens
ttatcttcctcccac

SEQ ID NO: 1224 - DNA, 15 bp, Homo sapiens
tatcttcctcccaca

SEQ ID NO: 1225 - DNA, 15 bp, Homo sapiens
atcttcctcccacag

SEQ ID NO: 1226 - DNA, 15 bp, Homo sapiens
tcttcctcccacagc

SEQ ID NO: 1227 - DNA, 15 bp, Homo sapiens
cttcctcccacagct

SEQ ID NO: 1228 - DNA, 15 bp, Homo sapiens
ttcctcccacagctc

SEQ ID NO: 1229 - DNA, 15 bp, Homo sapiens
tcctcccacagctcc

SEQ ID NO: 1230 - DNA, 15 bp, Homo sapiens
cctcccacagctcct

SEQ ID NO: 1231 - DNA, 15 bp, Homo sapiens
ctcccacagctcctg

SEQ ID NO: 1232 - DNA, 15 bp, Homo sapiens
tcccacagctcctgg

SEQ ID NO: 1233 - DNA, 15 bp, Homo sapiens
cccacagctcctggg

SEQ ID NO: 1234 - DNA, 15 bp, Homo sapiens
ccacagctcctgggc

SEQ ID NO: 1235 - DNA, 15 bp, Homo sapiens
cacagctcctgggca

SEQ ID NO: 1236 - DNA, 15 bp, Homo sapiens
acagctcctgggcaa

SEQ ID NO: 1237 - DNA, 15 bp, Homo sapiens
cagctcctgggcaac

SEQ ID NO: 1238 - DNA, 15 bp, Homo sapiens
agctcctgggcaacg

SEQ ID NO: 1239 - DNA, 15 bp, Homo sapiens
gctcctgggcaacgt

SEQ ID NO: 1240 - DNA, 15 bp, Homo sapiens
ctcctgggcaacgtg

SEQ ID NO: 1241 - DNA, 15 bp, Homo sapiens
tcctgggcaacgtgc

SEQ ID NO: 1242 - DNA, 15 bp, Homo sapiens
cctgggcaacgtgct

SEQ ID NO: 1243 - DNA, 15 bp, Homo sapiens
ctgggcaacgtgctg

SEQ ID NO: 1244 - DNA, 15 bp, Homo sapiens
tgggcaacgtgctgg

SEQ ID NO: 1245 - DNA, 15 bp, Homo sapiens
gggcaacgtgctggt

SEQ ID NO: 1246 - DNA, 15 bp, Homo sapiens
ggcaacgtgctggtc

SEQ ID NO: 1247 - DNA, 15 bp, Homo sapiens
gcaacgtgctggtct

SEQ ID NO: 1248 - DNA, 15 bp, Homo sapiens
caacgtgctggtctg

SEQ ID NO: 1249 - DNA, 15 bp, Homo sapiens
aacgtgctggtctgt

SEQ ID NO: 1250 - DNA, 15 bp, Homo sapiens
acgtgctggtctgtg

SEQ ID NO: 1251 - DNA, 15 bp, Homo sapiens
cgtgctggtctgtgt

SEQ ID NO: 1252 - DNA, 15 bp, Homo sapiens
gtgctggtctgtgtg

SEQ ID NO: 1253 - DNA, 15 bp, Homo sapiens
tgctggtctgtgtgc

SEQ ID NO: 1254 - DNA, 15 bp, Homo sapiens
gctggtctgtgtgct

SEQ ID NO: 1255 - DNA, 15 bp, Homo sapiens
ctggtctgtgtgctg

SEQ ID NO: 1256 - DNA, 15 bp, Homo sapiens
tggtctgtgtgctgg

SEQ ID NO: 1257 - DNA, 15 bp, Homo sapiens
ggtctgtgtgctggc

SEQ ID NO: 1258 - DNA, 15 bp, Homo sapiens
gtctgtgtgctggcc

SEQ ID NO: 1259 - DNA, 15 bp, Homo sapiens
tctgtgtgctggccc

SEQ ID NO: 1260 - DNA, 15 bp, Homo sapiens
ctgtgtgctggccca

SEQ ID NO: 1261 - DNA, 15 bp, Homo sapiens
tgtgtgctggcccat

SEQ ID NO: 1262 - DNA, 15 bp, Homo sapiens
gtgtgctggcccatc

SEQ ID NO: 1263 - DNA, 15 bp, Homo sapiens
tgtgctggcccatca

SEQ ID NO: 1264 - DNA, 15 bp, Homo sapiens
gtgctggcccatcac

SEQ ID NO: 1265 - DNA, 15 bp, Homo sapiens
tgctggcccatcact

SEQ ID NO: 1266 - DNA, 15 bp, Homo sapiens
gctggcccatcactt

SEQ ID NO: 1267 - DNA, 15 bp, Homo sapiens
ctggcccatcacttt

SEQ ID NO: 1268 - DNA, 15 bp, Homo sapiens
tggcccatcactttg

SEQ ID NO: 1269 - DNA, 15 bp, Homo sapiens
ggcccatcactttgg

SEQ ID NO: 1270 - DNA, 15 bp, Homo sapiens
gcccatcactttggc

SEQ ID NO: 1271 - DNA, 15 bp, Homo sapiens
cccatcactttggca

SEQ ID NO: 1272 - DNA, 15 bp, Homo sapiens
ccatcactttggcaa

SEQ ID NO: 1273 - DNA, 15 bp, Homo sapiens
catcactttggcaaa

SEQ ID NO: 1274 - DNA, 15 bp, Homo sapiens
atcactttggcaaag

SEQ ID NO: 1275 - DNA, 15 bp, Homo sapiens
tcactttggcaaaga

SEQ ID NO: 1276 - DNA, 15 bp, Homo sapiens
cactttggcaaagaa

SEQ ID NO: 1277 - DNA, 15 bp, Homo sapiens
actttggcaaagaat

SEQ ID NO: 1278 - DNA, 15 bp, Homo sapiens
ctttggcaaagaatt

SEQ ID NO: 1279 - DNA, 15 bp, Homo sapiens
tttggcaaagaattc

SEQ ID NO: 1280 - DNA, 15 bp, Homo sapiens
ttggcaaagaattca

SEQ ID NO: 1281 - DNA, 15 bp, Homo sapiens
tggcaaagaattcac

SEQ ID NO: 1282 - DNA, 15 bp, Homo sapiens
ggcaaagaattcacc

SEQ ID NO: 1283 - DNA, 15 bp, Homo sapiens
gcaaagaattcaccc

SEQ ID NO: 1284 - DNA, 15 bp, Homo sapiens
caaagaattcacccc

SEQ ID NO: 1285 - DNA, 15 bp, Homo sapiens
aaagaattcacccca

SEQ ID NO: 1286 - DNA, 15 bp, Homo sapiens
aagaattcaccccac

SEQ ID NO: 1287 - DNA, 15 bp, Homo sapiens
agaattcaccccacc

SEQ ID NO: 1288 - DNA, 15 bp, Homo sapiens
gaattcaccccacca

SEQ ID NO: 1289 - DNA, 15 bp, Homo sapiens
aattcaccccaccag

SEQ ID NO: 1290 - DNA, 15 bp, Homo sapiens
attcaccccaccagt

SEQ ID NO: 1291 - DNA, 15 bp, Homo sapiens
ttcaccccaccagtg

SEQ ID NO: 1292 - DNA, 15 bp, Homo sapiens
tcaccccaccagtgc

SEQ ID NO: 1293 - DNA, 15 bp, Homo sapiens
caccccaccagtgca

SEQ ID NO: 1294 - DNA, 15 bp, Homo sapiens
accccaccagtgcag

SEQ ID NO: 1295 - DNA, 15 bp, Homo sapiens
ccccaccagtgcagg

SEQ ID NO: 1296 - DNA, 15 bp, Homo sapiens
cccaccagtgcaggc

SEQ ID NO: 1297 - DNA, 15 bp, Homo sapiens
ccaccagtgcaggct

SEQ ID NO: 1298 - DNA, 15 bp, Homo sapiens
caccagtgcaggctg

SEQ ID NO: 1299 - DNA, 15 bp, Homo sapiens
accagtgcaggctgc

SEQ ID NO: 1300 - DNA, 15 bp, Homo sapiens
ccagtgcaggctgcc

SEQ ID NO: 1301 - DNA, 15 bp, Homo sapiens
cagtgcaggctgcct

SEQ ID NO: 1302 - DNA, 15 bp, Homo sapiens
agtgcaggctgccta

SEQ ID NO: 1303 - DNA, 15 bp, Homo sapiens
gtgcaggctgcctat

SEQ ID NO: 1304 - DNA, 15 bp, Homo sapiens
gctgcctatcagaaa

SEQ ID NO: 1305 - DNA, 15 bp, Homo sapiens
ctgcctatcagaaag

SEQ ID NO: 1306 - DNA, 15 bp, Homo sapiens
tgcctatcagaaagt

SEQ ID NO: 1307 - DNA, 15 bp, Homo sapiens
gcctatcagaaagtg

SEQ ID NO: 1308 - DNA, 15 bp, Homo sapiens
cctatcagaaagtgg

SEQ ID NO: 1309 - DNA, 15 bp, Homo sapiens
ctatcagaaagtggt

SEQ ID NO: 1310 - DNA, 15 bp, Homo sapiens
tatcagaaagtggtg

SEQ ID NO: 1311 - DNA, 15 bp, Homo sapiens
atcagaaagtggtgg

SEQ ID NO: 1312 - DNA, 15 bp, Homo sapiens
tcagaaagtggtggc

SEQ ID NO: 1313 - DNA, 15 bp, Homo sapiens
cagaaagtggtggct

SEQ ID NO: 1314 - DNA, 15 bp, Homo sapiens
agaaagtggtggctg

SEQ ID NO: 1315 - DNA, 15 bp, Homo sapiens
gaaagtggtggctgg

SEQ ID NO: 1316 - DNA, 15 bp, Homo sapiens
aaagtggtggctggt

SEQ ID NO: 1317 - DNA, 15 bp, Homo sapiens
aagtggtggctggtg

SEQ ID NO: 1318 - DNA, 15 bp, Homo sapiens
agtggtggctggtgt

SEQ ID NO: 1319 - DNA, 15 bp, Homo sapiens
gctaatgccctggcc

SEQ ID NO: 1320 - DNA, 15 bp, Homo sapiens
ctaatgccctggccc

SEQ ID NO: 1321 - DNA, 15 bp, Homo sapiens
taatgccctggccca

SEQ ID NO: 1322 - DNA, 15 bp, Homo sapiens
aatgccctggcccac

SEQ ID NO: 1323 - DNA, 15 bp, Homo sapiens
atgccctggcccaca

SEQ ID NO: 1324 - DNA, 15 bp, Homo sapiens
tgccctggcccacaa

SEQ ID NO: 1325 - DNA, 15 bp, Homo sapiens
gccctggcccacaag

SEQ ID NO: 1326 - DNA, 15 bp, Homo sapiens
ccctggcccacaagt

SEQ ID NO: 1327 - DNA, 15 bp, Homo sapiens
cctggcccacaagta

SEQ ID NO: 1328 - DNA, 15 bp, Homo sapiens
ctggcccacaagtat

SEQ ID NO: 1329 - DNA, 15 bp, Homo sapiens
tggcccacaagtatc

SEQ ID NO: 1330 - DNA, 15 bp, Homo sapiens
ggcccacaagtatca

SEQ ID NO: 1331 - DNA, 15 bp, Homo sapiens
gcccacaagtatcac

SEQ ID NO: 1332 - DNA, 15 bp, Homo sapiens
cccacaagtatcact

SEQ ID NO: 1333 - DNA, 15 bp, Homo sapiens
ccacaagtatcacta

SEQ ID NO: 1334 - DNA, 15 bp, Homo sapiens
cacaagtatcactaa

SEQ ID NO: 1335 - DNA, 15 bp, Homo sapiens
acaagtatcactaag

SEQ ID NO: 1336 - DNA, 15 bp, Homo sapiens
caagtatcactaagc

SEQ ID NO: 1337 - DNA, 15 bp, Homo sapiens
aagtatcactaagct

SEQ ID NO: 1338 - DNA, 15 bp, Homo sapiens
agtatcactaagctc

SEQ ID NO: 1339 - DNA, 15 bp, Homo sapiens
gtatcactaagctcg

SEQ ID NO: 1340 - DNA, 15 bp, Homo sapiens
tatcactaagctcgc

SEQ ID NO: 1341 - DNA, 15 bp, Homo sapiens
atcactaagctcgct

SEQ ID NO: 1342 - DNA, 15 bp, Homo sapiens
tcactaagctcgctt

SEQ ID NO: 1343 - DNA, 15 bp, Homo sapiens
cactaagctcgcttt

SEQ ID NO: 1344 - DNA, 15 bp, Homo sapiens
actaagctcgctttc

SEQ ID NO: 1345 - DNA, 15 bp, Homo sapiens
ctaagctcgctttct

SEQ ID NO: 1346 - DNA, 15 bp, Homo sapiens
taagctcgctttctt

SEQ ID NO: 1347 - DNA, 15 bp, Homo sapiens
aagctcgctttcttg

SEQ ID NO: 1348 - DNA, 15 bp, Homo sapiens
agctcgctttcttgc

SEQ ID NO: 1349 - DNA, 15 bp, Homo sapiens
gctcgctttcttgct

SEQ ID NO: 1350 - DNA, 15 bp, Homo sapiens
ctcgctttcttgctg

SEQ ID NO: 1351 - DNA, 15 bp, Homo sapiens
tcgctttcttgctgt

SEQ ID NO: 1352 - DNA, 15 bp, Homo sapiens
cgctttcttgctgtc

SEQ ID NO: 1353 - DNA, 15 bp, Homo sapiens
gctttcttgctgtcc

SEQ ID NO: 1354 - DNA, 15 bp, Homo sapiens
ctttcttgctgtcca

SEQ ID NO: 1355 - DNA, 15 bp, Homo sapiens
tttcttgctgtccaa

SEQ ID NO: 1356 - DNA, 15 bp, Homo sapiens
ttcttgctgtccaat

SEQ ID NO: 1357 - DNA, 15 bp, Homo sapiens
tcttgctgtccaatt

SEQ ID NO: 1358 - DNA, 15 bp, Homo sapiens
cttgctgtccaattt

SEQ ID NO: 1359 - DNA, 15 bp, Homo sapiens
ttgctgtccaatttc

SEQ ID NO: 1360 - DNA, 15 bp, Homo sapiens
tgctgtccaatttct

SEQ ID NO: 1361 - DNA, 15 bp, Homo sapiens
gctgtccaatttcta

SEQ ID NO: 1362 - DNA, 15 bp, Homo sapiens
ctgtccaatttctat

SEQ ID NO: 1363 - DNA, 15 bp, Homo sapiens
tgtccaatttctatt

SEQ ID NO: 1364 - DNA, 15 bp, Homo sapiens
gtccaatttctatta

SEQ ID NO: 1365 - DNA, 15 bp, Homo sapiens
tccaatttctattaa

SEQ ID NO: 1366 - DNA, 15 bp, Homo sapiens
ccaatttctattaaa

SEQ ID NO: 1367 - DNA, 15 bp, Homo sapiens
caatttctattaaag

SEQ ID NO: 1368 - DNA, 15 bp, Homo sapiens
aatttctattaaagg

SEQ ID NO: 1369 - DNA, 15 bp, Homo sapiens
atttctattaaaggt

SEQ ID NO: 1370 - DNA, 15 bp, Homo sapiens
tttctattaaaggtt

SEQ ID NO: 1371 - DNA, 15 bp, Homo sapiens
ttctattaaaggttc

SEQ ID NO: 1372 - DNA, 15 bp, Homo sapiens
tctattaaaggttcc

SEQ ID NO: 1373 - DNA, 15 bp, Homo sapiens
ctattaaaggttcct

SEQ ID NO: 1374 - DNA, 15 bp, Homo sapiens
tattaaaggttcctt

SEQ ID NO: 1375 - DNA, 15 bp, Homo sapiens
attaaaggttccttt

SEQ ID NO: 1376 - DNA, 15 bp, Homo sapiens
ttaaaggttcctttg

SEQ ID NO: 1377 - DNA, 15 bp, Homo sapiens
taaaggttcctttgt

SEQ ID NO: 1378 - DNA, 15 bp, Homo sapiens
aaaggttcctttgtt

SEQ ID NO: 1379 - DNA, 15 bp, Homo sapiens
aaggttcctttgttc

SEQ ID NO: 1380 - DNA, 15 bp, Homo sapiens
aggttcctttgttcc

SEQ ID NO: 1381 - DNA, 15 bp, Homo sapiens
ggttcctttgttccc

SEQ ID NO: 1382 - DNA, 15 bp, Homo sapiens
gttcctttgttccct

SEQ ID NO: 1383 - DNA, 15 bp, Homo sapiens
ttcctttgttcccta

SEQ ID NO: 1384 - DNA, 15 bp, Homo sapiens
tcctttgttccctaa

SEQ ID NO: 1385 - DNA, 15 bp, Homo sapiens
cctttgttccctaag

SEQ ID NO: 1386 - DNA, 15 bp, Homo sapiens
ctttgttccctaagt

SEQ ID NO: 1387 - DNA, 15 bp, Homo sapiens
tttgttccctaagtc

SEQ ID NO: 1388 - DNA, 15 bp, Homo sapiens
ttgttccctaagtcc

SEQ ID NO: 1389 - DNA, 15 bp, Homo sapiens
tgttccctaagtcca

SEQ ID NO: 1390 - DNA, 15 bp, Homo sapiens
gttccctaagtccaa

SEQ ID NO: 1391 - DNA, 15 bp, Homo sapiens
ttccctaagtccaac

SEQ ID NO: 1392 - DNA, 15 bp, Homo sapiens
tccctaagtccaact

SEQ ID NO: 1393 - DNA, 15 bp, Homo sapiens
ccctaagtccaacta

SEQ ID NO: 1394 - DNA, 15 bp, Homo sapiens
cctaagtccaactac

SEQ ID NO: 1395 - DNA, 15 bp, Homo sapiens
ctaagtccaactact

SEQ ID NO: 1396 - DNA, 15 bp, Homo sapiens
taagtccaactacta

SEQ ID NO: 1397 - DNA, 15 bp, Homo sapiens
aagtccaactactaa

SEQ ID NO: 1398 - DNA, 15 bp, Homo sapiens
agtccaactactaaa

SEQ ID NO: 1399 - DNA, 15 bp, Homo sapiens
gtccaactactaaac

SEQ ID NO: 1400 - DNA, 15 bp, Homo sapiens
tccaactactaaact

SEQ ID NO: 1401 - DNA, 15 bp, Homo sapiens
ccaactactaaactg

SEQ ID NO: 1402 - DNA, 15 bp, Homo sapiens
caactactaaactgg

SEQ ID NO: 1403 - DNA, 15 bp, Homo sapiens
aactactaaactggg

SEQ ID NO: 1404 - DNA, 15 bp, Homo sapiens
actactaaactgggg

SEQ ID NO: 1405 - DNA, 15 bp, Homo sapiens
ctactaaactggggg

SEQ ID NO: 1406 - DNA, 15 bp, Homo sapiens
tactaaactggggga

SEQ ID NO: 1407 - DNA, 15 bp, Homo sapiens
actaaactgggggat

SEQ ID NO: 1408 - DNA, 15 bp, Homo sapiens
ctaaactgggggata

SEQ ID NO: 1409 - DNA, 15 bp, Homo sapiens
taaactgggggatat

SEQ ID NO: 1410 - DNA, 15 bp, Homo sapiens
aaactgggggatatt

SEQ ID NO: 1411 - DNA, 15 bp, Homo sapiens
aactgggggatatta

SEQ ID NO: 1412 - DNA, 15 bp, Homo sapiens
actgggggatattat

SEQ ID NO: 1413 - DNA, 15 bp, Homo sapiens
ctgggggatattatg

SEQ ID NO: 1414 - DNA, 15 bp, Homo sapiens
tgggggatattatga

SEQ ID NO: 1415 - DNA, 15 bp, Homo sapiens
gggggatattatgaa

SEQ ID NO: 1416 - DNA, 15 bp, Homo sapiens
ggggatattatgaag

SEQ ID NO: 1417 - DNA, 15 bp, Homo sapiens
gggatattatgaagg

SEQ ID NO: 1418 - DNA, 15 bp, Homo sapiens
ggatattatgaaggg

SEQ ID NO: 1419 - DNA, 15 bp, Homo sapiens
gatattatgaagggc

SEQ ID NO: 1420 - DNA, 15 bp, Homo sapiens
atattatgaagggcc

SEQ ID NO: 1421 - DNA, 15 bp, Homo sapiens
tattatgaagggcct

SEQ ID NO: 1422 - DNA, 15 bp, Homo sapiens
attatgaagggcctt

SEQ ID NO: 1423 - DNA, 15 bp, Homo sapiens
ttatgaagggccttg

SEQ ID NO: 1424 - DNA, 15 bp, Homo sapiens
tatgaagggccttga

SEQ ID NO: 1425 - DNA, 15 bp, Homo sapiens
atgaagggccttgag

SEQ ID NO: 1426 - DNA, 15 bp, Homo sapiens
tgaagggccttgagc

SEQ ID NO: 1427 - DNA, 15 bp, Homo sapiens
gaagggccttgagca

SEQ ID NO: 1428 - DNA, 15 bp, Homo sapiens
aagggccttgagcat

SEQ ID NO: 1429 - DNA, 15 bp, Homo sapiens
agggccttgagcatc

SEQ ID NO: 1430 - DNA, 15 bp, Homo sapiens
gggccttgagcatct

SEQ ID NO: 1431 - DNA, 15 bp, Homo sapiens
ggccttgagcatctg

SEQ ID NO: 1432 - DNA, 15 bp, Homo sapiens
gccttgagcatctgg

SEQ ID NO: 1433 - DNA, 15 bp, Homo sapiens
ccttgagcatctgga

SEQ ID NO: 1434 - DNA, 15 bp, Homo sapiens
cttgagcatctggat

SEQ ID NO: 1435 - DNA, 15 bp, Homo sapiens
ttgagcatctggatt

SEQ ID NO: 1436 - DNA, 15 bp, Homo sapiens
tgagcatctggattc

SEQ ID NO: 1437 - DNA, 15 bp, Homo sapiens
gagcatctggattct

SEQ ID NO: 1438 - DNA, 15 bp, Homo sapiens
agcatctggattctg

SEQ ID NO: 1439 - DNA, 15 bp, Homo sapiens
gcatctggattctgc

SEQ ID NO: 1440 - DNA, 15 bp, Homo sapiens
catctggattctgcc

SEQ ID NO: 1441 - DNA, 15 bp, Homo sapiens
atctggattctgcct

SEQ ID NO: 1442 - DNA, 15 bp, Homo sapiens
tctggattctgccta

SEQ ID NO: 1443 - DNA, 15 bp, Homo sapiens
ctggattctgcctaa

SEQ ID NO: 1444 - DNA, 15 bp, Homo sapiens
tggattctgcctaat

SEQ ID NO: 1445 - DNA, 15 bp, Homo sapiens
ggattctgcctaata

SEQ ID NO: 1446 - DNA, 15 bp, Homo sapiens
gattctgcctaataa

SEQ ID NO: 1447 - DNA, 15 bp, Homo sapiens
attctgcctaataaa

SEQ ID NO: 1448 - DNA, 15 bp, Homo sapiens
ttctgcctaataaaa

SEQ ID NO: 1449 - DNA, 15 bp, Homo sapiens
tctgcctaataaaaa

SEQ ID NO: 1450 - DNA, 15 bp, Homo sapiens
ctgcctaataaaaaa

SEQ ID NO: 1451 - DNA, 15 bp, Homo sapiens
tgcctaataaaaaac

SEQ ID NO: 1452 - DNA, 15 bp, Homo sapiens
gcctaataaaaaaca

SEQ ID NO: 1453 - DNA, 15 bp, Homo sapiens
cctaataaaaaacat

SEQ ID NO: 1454 - DNA, 15 bp, Homo sapiens
ctaataaaaaacatt

SEQ ID NO: 1455 - DNA, 15 bp, Homo sapiens
taataaaaaacattt

SEQ ID NO: 1456 - DNA, 15 bp, Homo sapiens
aataaaaaacattta

SEQ ID NO: 1457 - DNA, 15 bp, Homo sapiens
ataaaaaacatttat

SEQ ID NO: 1458 - DNA, 15 bp, Homo sapiens
taaaaaacatttatt

SEQ ID NO: 1459 - DNA, 15 bp, Homo sapiens
aaaaaacatttattt

SEQ ID NO: 1460 - DNA, 15 bp, Homo sapiens
aaaaacatttatttt

SEQ ID NO: 1461 - DNA, 15 bp, Homo sapiens
aaaacatttattttc

SEQ ID NO: 1462 - DNA, 15 bp, Homo sapiens
aaacatttattttca

SEQ ID NO: 1463 - DNA, 15 bp, Homo sapiens
aacatttattttcat

SEQ ID NO: 1464 - DNA, 15 bp, Homo sapiens
acatttattttcatt

SEQ ID NO: 1465 - DNA, 15 bp, Homo sapiens
catttattttcattg

SEQ ID NO: 1466 - DNA, 15 bp, Homo sapiens
atttattttcattgc

SEQ ID NO: 1467 - DNA, 15 bp, Homo sapiens
tttattttcattgca

SEQ ID NO: 1468 - DNA, 15 bp, Homo sapiens
ttattttcattgcaa

SEQ ID NO: 1469 - DNA, 15 bp, Homo sapiens
tattttcattgcaat

SEQ ID NO: 1470 - DNA, 15 bp, Homo sapiens
attttcattgcaatg

SEQ ID NO: 1471 - DNA, 15 bp, Homo sapiens
ttttcattgcaatga

SEQ ID NO: 1472 - DNA, 15 bp, Homo sapiens
tttcattgcaatgat

SEQ ID NO: 1473 - DNA, 15 bp, Homo sapiens
ttcattgcaatgatg

SEQ ID NO: 1474 - DNA, 15 bp, Homo sapiens
tcattgcaatgatgt

SEQ ID NO: 1475 - DNA, 15 bp, Homo sapiens
cattgcaatgatgta

SEQ ID NO: 1476 - DNA, 15 bp, Homo sapiens
attgcaatgatgtat

SEQ ID NO: 1477 - DNA, 15 bp, Homo sapiens
ttgcaatgatgtatt

SEQ ID NO: 1478 - DNA, 15 bp, Homo sapiens
tgcaatgatgtattt

SEQ ID NO: 1479 - DNA, 15 bp, Homo sapiens
gcaatgatgtattta

SEQ ID NO: 1480 - DNA, 15 bp, Homo sapiens
caatgatgtatttaa

SEQ ID NO: 1481 - DNA, 15 bp, Homo sapiens
aatgatgtatttaaa

SEQ ID NO: 1482 - DNA, 15 bp, Homo sapiens
atgatgtatttaaat

SEQ ID NO: 1483 - DNA, 15 bp, Homo sapiens
tgatgtatttaaatt

SEQ ID NO: 1484 - DNA, 15 bp, Homo sapiens
gatgtatttaaatta

SEQ ID NO: 1485 - DNA, 15 bp, Homo sapiens
atgtatttaaattat

SEQ ID NO: 1486 - DNA, 15 bp, Homo sapiens
tgtatttaaattatt

SEQ ID NO: 1487 - DNA, 15 bp, Homo sapiens
gtatttaaattattt

SEQ ID NO: 1488 - DNA, 15 bp, Homo sapiens
tatttaaattatttc

SEQ ID NO: 1489 - DNA, 15 bp, Homo sapiens
atttaaattatttct

SEQ ID NO: 1490 - DNA, 15 bp, Homo sapiens
tttaaattatttctg

SEQ ID NO: 1491 - DNA, 15 bp, Homo sapiens
ttaaattatttctga

SEQ ID NO: 1492 - DNA, 15 bp, Homo sapiens
taaattatttctgaa

SEQ ID NO: 1493 - DNA, 15 bp, Homo sapiens
aaattatttctgaat

SEQ ID NO: 1494 - DNA, 15 bp, Homo sapiens
aattatttctgaata

SEQ ID NO: 1495 - DNA, 15 bp, Homo sapiens
attatttctgaatat

SEQ ID NO: 1496 - DNA, 15 bp, Homo sapiens
ttatttctgaatatt

SEQ ID NO: 1497 - DNA, 15 bp, Homo sapiens
tatttctgaatattt

SEQ ID NO: 1498 - DNA, 15 bp, Homo sapiens
atttctgaatatttt

SEQ ID NO: 1499 - DNA, 15 bp, Homo sapiens
tttctgaatatttta

SEQ ID NO: 1500 - DNA, 15 bp, Homo sapiens
ttctgaatattttac

SEQ ID NO: 1501 - DNA, 15 bp, Homo sapiens
tctgaatattttact

SEQ ID NO: 1502 - DNA, 15 bp, Homo sapiens
ctgaatattttacta

SEQ ID NO: 1503 - DNA, 15 bp, Homo sapiens
tgaatattttactaa

SEQ ID NO: 1504 - DNA, 15 bp, Homo sapiens
gaatattttactaaa

SEQ ID NO: 1505 - DNA, 15 bp, Homo sapiens
aatattttactaaaa

SEQ ID NO: 1506 - DNA, 15 bp, Homo sapiens
atattttactaaaaa

SEQ ID NO: 1507 - DNA, 15 bp, Homo sapiens
tattttactaaaaag

SEQ ID NO: 1508 - DNA, 15 bp, Homo sapiens
attttactaaaaagg

SEQ ID NO: 1509 - DNA, 15 bp, Homo sapiens
ttttactaaaaaggg

SEQ ID NO: 1510 - DNA, 15 bp, Homo sapiens
tttactaaaaaggga

SEQ ID NO: 1511 - DNA, 15 bp, Homo sapiens
ttactaaaaagggaa

SEQ ID NO: 1512 - DNA, 15 bp, Homo sapiens
tactaaaaagggaat

SEQ ID NO: 1513 - DNA, 15 bp, Homo sapiens
actaaaaagggaatg

SEQ ID NO: 1514 - DNA, 15 bp, Homo sapiens
ctaaaaagggaatgt

SEQ ID NO: 1515 - DNA, 15 bp, Homo sapiens
taaaaagggaatgtg

SEQ ID NO: 1516 - DNA, 15 bp, Homo sapiens
aaaaagggaatgtgg

SEQ ID NO: 1517 - DNA, 15 bp, Homo sapiens
aaaagggaatgtggg

SEQ ID NO: 1518 - DNA, 15 bp, Homo sapiens
aaagggaatgtggga

SEQ ID NO: 1519 - DNA, 15 bp, Homo sapiens
aagggaatgtgggag

SEQ ID NO: 1520 - DNA, 15 bp, Homo sapiens
agggaatgtgggagg

SEQ ID NO: 1521 - DNA, 15 bp, Homo sapiens
gggaatgtgggaggt

SEQ ID NO: 1522 - DNA, 15 bp, Homo sapiens
ggaatgtgggaggtc

SEQ ID NO: 1523 - DNA, 15 bp, Homo sapiens
gaatgtgggaggtca

SEQ ID NO: 1524 - DNA, 15 bp, Homo sapiens
aatgtgggaggtcag

SEQ ID NO: 1525 - DNA, 15 bp, Homo sapiens
atgtgggaggtcagt

SEQ ID NO: 1526 - DNA, 15 bp, Homo sapiens
tgtgggaggtcagtg

SEQ ID NO: 1527 - DNA, 15 bp, Homo sapiens
gtgggaggtcagtgc

SEQ ID NO: 1528 - DNA, 15 bp, Homo sapiens
tgggaggtcagtgca

SEQ ID NO: 1529 - DNA, 15 bp, Homo sapiens
gggaggtcagtgcat

SEQ ID NO: 1530 - DNA, 15 bp, Homo sapiens
ggaggtcagtgcatt

SEQ ID NO: 1531 - DNA, 15 bp, Homo sapiens
gaggtcagtgcattt

SEQ ID NO: 1532 - DNA, 15 bp, Homo sapiens
aggtcagtgcattta

SEQ ID NO: 1533 - DNA, 15 bp, Homo sapiens
ggtcagtgcatttaa

SEQ ID NO: 1534 - DNA, 15 bp, Homo sapiens
gtcagtgcatttaaa

SEQ ID NO: 1535 - DNA, 15 bp, Homo sapiens
tcagtgcatttaaaa

SEQ ID NO: 1536 - DNA, 15 bp, Homo sapiens
cagtgcatttaaaac

SEQ ID NO: 1537 - DNA, 15 bp, Homo sapiens
agtgcatttaaaaca

SEQ ID NO: 1538 - DNA, 15 bp, Homo sapiens
gtgcatttaaaacat

SEQ ID NO: 1539 - DNA, 15 bp, Homo sapiens
tgcatttaaaacata

SEQ ID NO: 1540 - DNA, 15 bp, Homo sapiens
gcatttaaaacataa

SEQ ID NO: 1541 - DNA, 15 bp, Homo sapiens
catttaaaacataaa

SEQ ID NO: 1542 - DNA, 15 bp, Homo sapiens
atttaaaacataaag

SEQ ID NO: 1543 - DNA, 15 bp, Homo sapiens
tttaaaacataaaga

SEQ ID NO: 1544 - DNA, 15 bp, Homo sapiens
ttaaaacataaagaa

SEQ ID NO: 1545 - DNA, 15 bp, Homo sapiens
taaaacataaagaaa

SEQ ID NO: 1546 - DNA, 15 bp, Homo sapiens
aaaacataaagaaat

SEQ ID NO: 1547 - DNA, 15 bp, Homo sapiens
aaacataaagaaatg

SEQ ID NO: 1548 - DNA, 15 bp, Homo sapiens
aacataaagaaatga

SEQ ID NO: 1549 - DNA, 15 bp, Homo sapiens
acataaagaaatgaa

SEQ ID NO: 1550 - DNA, 15 bp, Homo sapiens
cataaagaaatgaag

SEQ ID NO: 1551 - DNA, 15 bp, Homo sapiens
ataaagaaatgaaga

SEQ ID NO: 1552 - DNA, 15 bp, Homo sapiens
taaagaaatgaagag

SEQ ID NO: 1553 - DNA, 15 bp, Homo sapiens
aaagaaatgaagagc

SEQ ID NO: 1554 - DNA, 15 bp, Homo sapiens
aagaaatgaagagct

SEQ ID NO: 1555 - DNA, 15 bp, Homo sapiens
agaaatgaagagcta

SEQ ID NO: 1556 - DNA, 15 bp, Homo sapiens
gaaatgaagagctag

SEQ ID NO: 1557 - DNA, 15 bp, Homo sapiens
aaatgaagagctagt

SEQ ID NO: 1558 - DNA, 15 bp, Homo sapiens
aatgaagagctagtt

SEQ ID NO: 1559 - DNA, 15 bp, Homo sapiens
atgaagagctagttc

SEQ ID NO: 1560 - DNA, 15 bp, Homo sapiens
tgaagagctagttca

SEQ ID NO: 1561 - DNA, 15 bp, Homo sapiens
gaagagctagttcaa

SEQ ID NO: 1562 - DNA, 15 bp, Homo sapiens
aagagctagttcaaa

SEQ ID NO: 1563 - DNA, 15 bp, Homo sapiens
agagctagttcaaac

SEQ ID NO: 1564 - DNA, 15 bp, Homo sapiens
gagctagttcaaacc

SEQ ID NO: 1565 - DNA, 15 bp, Homo sapiens
agctagttcaaacct

SEQ ID NO: 1566 - DNA, 15 bp, Homo sapiens
gctagttcaaacctt

SEQ ID NO: 1567 - DNA, 15 bp, Homo sapiens
ctagttcaaaccttg

SEQ ID NO: 1568 - DNA, 15 bp, Homo sapiens
tagttcaaaccttgg

SEQ ID NO: 1569 - DNA, 15 bp, Homo sapiens
agttcaaaccttggg

SEQ ID NO: 1570 - DNA, 15 bp, Homo sapiens
gttcaaaccttggga

SEQ ID NO: 1571 - DNA, 15 bp, Homo sapiens
ttcaaaccttgggaa

SEQ ID NO: 1572 - DNA, 15 bp, Homo sapiens
tcaaaccttgggaaa

SEQ ID NO: 1573 - DNA, 15 bp, Homo sapiens
caaaccttgggaaaa

SEQ ID NO: 1574 - DNA, 15 bp, Homo sapiens
aaaccttgggaaaat

SEQ ID NO: 1575 - DNA, 15 bp, Homo sapiens
aaccttgggaaaata

SEQ ID NO: 1576 - DNA, 15 bp, Homo sapiens
accttgggaaaatac

SEQ ID NO: 1577 - DNA, 15 bp, Homo sapiens
ccttgggaaaataca

SEQ ID NO: 1578 - DNA, 15 bp, Homo sapiens
cttgggaaaatacac

SEQ ID NO: 1579 - DNA, 15 bp, Homo sapiens
ttgggaaaatacact

SEQ ID NO: 1580 - DNA, 15 bp, Homo sapiens
tgggaaaatacacta

SEQ ID NO: 1581 - DNA, 15 bp, Homo sapiens
gggaaaatacactat

SEQ ID NO: 1582 - DNA, 15 bp, Homo sapiens
ggaaaatacactata

SEQ ID NO: 1583 - DNA, 15 bp, Homo sapiens
gaaaatacactatat

SEQ ID NO: 1584 - DNA, 15 bp, Homo sapiens
aaaatacactatatc

SEQ ID NO: 1585 - DNA, 15 bp, Homo sapiens
aaatacactatatct

SEQ ID NO: 1586 - DNA, 15 bp, Homo sapiens
aatacactatatctt

SEQ ID NO: 1587 - DNA, 15 bp, Homo sapiens
atacactatatctta

SEQ ID NO: 1588 - DNA, 15 bp, Homo sapiens
tacactatatcttaa

SEQ ID NO: 1589 - DNA, 15 bp, Homo sapiens
acactatatcttaaa

SEQ ID NO: 1590 - DNA, 15 bp, Homo sapiens
cactatatcttaaac

SEQ ID NO: 1591 - DNA, 15 bp, Homo sapiens
actatatcttaaact

SEQ ID NO: 1592 - DNA, 15 bp, Homo sapiens
ctatatcttaaactc

SEQ ID NO: 1593 - DNA, 15 bp, Homo sapiens
tatatcttaaactcc

SEQ ID NO: 1594 - DNA, 15 bp, Homo sapiens
atatcttaaactcca

SEQ ID NO: 1595 - DNA, 15 bp, Homo sapiens
tatcttaaactccat

SEQ ID NO: 1596 - DNA, 15 bp, Homo sapiens
atcttaaactccatg

SEQ ID NO: 1597 - DNA, 15 bp, Homo sapiens
tcttaaactccatga

SEQ ID NO: 1598 - DNA, 15 bp, Homo sapiens
cttaaactccatgaa

SEQ ID NO: 1599 - DNA, 15 bp, Homo sapiens
ttaaactccatgaaa

SEQ ID NO: 1600 - DNA, 15 bp, Homo sapiens
taaactccatgaaag

SEQ ID NO: 1601 - DNA, 15 bp, Homo sapiens
aaactccatgaaaga

SEQ ID NO: 1602 - DNA, 15 bp, Homo sapiens
aactccatgaaagaa

SEQ ID NO: 1603 - DNA, 15 bp, Homo sapiens
actccatgaaagaag

SEQ ID NO: 1604 - DNA, 15 bp, Homo sapiens
ctccatgaaagaagg

SEQ ID NO: 1605 - DNA, 15 bp, Homo sapiens
tccatgaaagaaggt

SEQ ID NO: 1606 - DNA, 15 bp, Homo sapiens
ccatgaaagaaggtg

SEQ ID NO: 1607 - DNA, 15 bp, Homo sapiens
catgaaagaaggtga

SEQ ID NO: 1608 - DNA, 15 bp, Homo sapiens
atgaaagaaggtgag

SEQ ID NO: 1609 - DNA, 15 bp, Homo sapiens
tgaaagaaggtgagg

SEQ ID NO: 1610 - DNA, 15 bp, Homo sapiens
gaaagaaggtgaggc

SEQ ID NO: 1611 - DNA, 15 bp, Homo sapiens
aaagaaggtgaggct

SEQ ID NO: 1612 - DNA, 15 bp, Homo sapiens
aagaaggtgaggctg

SEQ ID NO: 1613 - DNA, 15 bp, Homo sapiens
agaaggtgaggctgc

SEQ ID NO: 1614 - DNA, 15 bp, Homo sapiens
gaaggtgaggctgca

SEQ ID NO: 1615 - DNA, 15 bp, Homo sapiens
aaggtgaggctgcaa

SEQ ID NO: 1616 - DNA, 15 bp, Homo sapiens
aggtgaggctgcaaa

SEQ ID NO: 1617 - DNA, 15 bp, Homo sapiens
ggtgaggctgcaaac

SEQ ID NO: 1618 - DNA, 15 bp, Homo sapiens
gtgaggctgcaaaca

SEQ ID NO: 1619 - DNA, 15 bp, Homo sapiens
tgaggctgcaaacag

SEQ ID NO: 1620 - DNA, 15 bp, Homo sapiens
gaggctgcaaacagc

SEQ ID NO: 1621 - DNA, 15 bp, Homo sapiens
aggctgcaaacagct

SEQ ID NO: 1622 - DNA, 15 bp, Homo sapiens
ggctgcaaacagcta

SEQ ID NO: 1623 - DNA, 15 bp, Homo sapiens
gctgcaaacagctaa

SEQ ID NO: 1624 - DNA, 15 bp, Homo sapiens
ctgcaaacagctaat

SEQ ID NO: 1625 - DNA, 15 bp, Homo sapiens
tgcaaacagctaatg

SEQ ID NO: 1626 - DNA, 15 bp, Homo sapiens
gcaaacagctaatgc

SEQ ID NO: 1627 - DNA, 15 bp, Homo sapiens
caaacagctaatgca

SEQ ID NO: 1628 - DNA, 15 bp, Homo sapiens
aaacagctaatgcac

SEQ ID NO: 1629 - DNA, 15 bp, Homo sapiens
aacagctaatgcaca

SEQ ID NO: 1630 - DNA, 15 bp, Homo sapiens
acagctaatgcacat

SEQ ID NO: 1631 - DNA, 15 bp, Homo sapiens
cagctaatgcacatt

SEQ ID NO: 1632 - DNA, 15 bp, Homo sapiens
agctaatgcacattg

SEQ ID NO: 1633 - DNA, 15 bp, Homo sapiens
gctaatgcacattgg

SEQ ID NO: 1634 - DNA, 15 bp, Homo sapiens
ctaatgcacattggc

SEQ ID NO: 1635 - DNA, 15 bp, Homo sapiens
taatgcacattggca

SEQ ID NO: 1636 - DNA, 15 bp, Homo sapiens
aatgcacattggcaa

SEQ ID NO: 1637 - DNA, 15 bp, Homo sapiens
atgcacattggcaac

SEQ ID NO: 1638 - DNA, 15 bp, Homo sapiens
tgcacattggcaaca

SEQ ID NO: 1639 - DNA, 15 bp, Homo sapiens
gcacattggcaacag

SEQ ID NO: 1640 - DNA, 15 bp, Homo sapiens
cacattggcaacagc

SEQ ID NO: 1641 - DNA, 15 bp, Homo sapiens
acattggcaacagcc

SEQ ID NO: 1642 - DNA, 15 bp, Homo sapiens
cattggcaacagccc

SEQ ID NO: 1643 - DNA, 15 bp, Homo sapiens
attggcaacagcccc

SEQ ID NO: 1644 - DNA, 15 bp, Homo sapiens
ttggcaacagcccct

SEQ ID NO: 1645 - DNA, 15 bp, Homo sapiens
tggcaacagcccctg

SEQ ID NO: 1646 - DNA, 15 bp, Homo sapiens
ggcaacagcccctga

SEQ ID NO: 1647 - DNA, 15 bp, Homo sapiens
gcaacagcccctgat

SEQ ID NO: 1648 - DNA, 15 bp, Homo sapiens
caacagcccctgatg

SEQ ID NO: 1649 - DNA, 15 bp, Homo sapiens
aacagcccctgatgc

SEQ ID NO: 1650 - DNA, 15 bp, Homo sapiens
acagcccctgatgca

SEQ ID NO: 1651 - DNA, 15 bp, Homo sapiens
cagcccctgatgcat

SEQ ID NO: 1652 - DNA, 15 bp, Homo sapiens
agcccctgatgcata

SEQ ID NO: 1653 - DNA, 15 bp, Homo sapiens
gcccctgatgcatat

SEQ ID NO: 1654 - DNA, 15 bp, Homo sapiens
cccctgatgcatatg

SEQ ID NO: 1655 - DNA, 15 bp, Homo sapiens
ccctgatgcatatgc

SEQ ID NO: 1656 - DNA, 15 bp, Homo sapiens
cctgatgcatatgcc

SEQ ID NO: 1657 - DNA, 15 bp, Homo sapiens
ctgatgcatatgcct

SEQ ID NO: 1658 - DNA, 15 bp, Homo sapiens
tgatgcatatgcctt

SEQ ID NO: 1659 - DNA, 15 bp, Homo sapiens
gatgcatatgcctta

SEQ ID NO: 1660 - DNA, 15 bp, Homo sapiens
atgcatatgccttat

SEQ ID NO: 1661 - DNA, 15 bp, Homo sapiens
tgcatatgccttatt

SEQ ID NO: 1662 - DNA, 15 bp, Homo sapiens
gcatatgccttattc

SEQ ID NO: 1663 - DNA, 15 bp, Homo sapiens
catatgccttattca

SEQ ID NO: 1664 - DNA, 15 bp, Homo sapiens
atatgccttattcat

SEQ ID NO: 1665 - DNA, 15 bp, Homo sapiens
tatgccttattcatc

SEQ ID NO: 1666 - DNA, 15 bp, Homo sapiens
atgccttattcatcc

SEQ ID NO: 1667 - DNA, 15 bp, Homo sapiens
tgccttattcatccc

SEQ ID NO: 1668 - DNA, 15 bp, Homo sapiens
gccttattcatccct

SEQ ID NO: 1669 - DNA, 15 bp, Homo sapiens
ccttattcatccctc

SEQ ID NO: 1670 - DNA, 15 bp, Homo sapiens
cttattcatccctca

SEQ ID NO: 1671 - DNA, 15 bp, Homo sapiens
ttattcatccctcag

SEQ ID NO: 1672 - DNA, 15 bp, Homo sapiens
tattcatccctcaga

SEQ ID NO: 1673 - DNA, 15 bp, Homo sapiens
attcatccctcagaa

SEQ ID NO: 1674 - DNA, 15 bp, Homo sapiens
ttcatccctcagaaa

SEQ ID NO: 1675 - DNA, 15 bp, Homo sapiens
tcatccctcagaaaa

SEQ ID NO: 1676 - DNA, 15 bp, Homo sapiens
catccctcagaaaag

SEQ ID NO: 1677 - DNA, 15 bp, Homo sapiens
atccctcagaaaagg

SEQ ID NO: 1678 - DNA, 15 bp, Homo sapiens
tccctcagaaaagga

SEQ ID NO: 1679 - DNA, 15 bp, Homo sapiens
ccctcagaaaaggat

SEQ ID NO: 1680 - DNA, 15 bp, Homo sapiens
cctcagaaaaggatt

SEQ ID NO: 1681 - DNA, 15 bp, Homo sapiens
ctcagaaaaggattc

SEQ ID NO: 1682 - DNA, 15 bp, Homo sapiens
tcagaaaaggattca

SEQ ID NO: 1683 - DNA, 15 bp, Homo sapiens
cagaaaaggattcaa

SEQ ID NO: 1684 - DNA, 15 bp, Homo sapiens
agaaaaggattcaag

SEQ ID NO: 1685 - DNA, 15 bp, Homo sapiens
gaaaaggattcaagt

SEQ ID NO: 1686 - DNA, 15 bp, Homo sapiens
aaaaggattcaagta

SEQ ID NO: 1687 - DNA, 15 bp, Homo sapiens
aaaggattcaagtag

SEQ ID NO: 1688 - DNA, 15 bp, Homo sapiens
aaggattcaagtaga

SEQ ID NO: 1689 - DNA, 15 bp, Homo sapiens
aggattcaagtagag

SEQ ID NO: 1690 - DNA, 15 bp, Homo sapiens
ggattcaagtagagg

SEQ ID NO: 1691 - DNA, 15 bp, Homo sapiens
gattcaagtagaggc

SEQ ID NO: 1692 - DNA, 15 bp, Homo sapiens
attcaagtagaggct

SEQ ID NO: 1693 - DNA, 15 bp, Homo sapiens
ttcaagtagaggctt

SEQ ID NO: 1694 - DNA, 15 bp, Homo sapiens
tcaagtagaggcttg

SEQ ID NO: 1695 - DNA, 15 bp, Homo sapiens
caagtagaggcttga

SEQ ID NO: 1696 - DNA, 15 bp, Homo sapiens
aagtagaggcttgat

SEQ ID NO: 1697 - DNA, 15 bp, Homo sapiens
agtagaggcttgatt

SEQ ID NO: 1698 - DNA, 15 bp, Homo sapiens
gtagaggcttgattt

SEQ ID NO: 1699 - DNA, 15 bp, Homo sapiens
tagaggcttgatttg

SEQ ID NO: 1700 - DNA, 15 bp, Homo sapiens
agaggcttgatttgg

SEQ ID NO: 1701 - DNA, 15 bp, Homo sapiens
gaggcttgatttgga

SEQ ID NO: 1702 - DNA, 15 bp, Homo sapiens
aggcttgatttggag

SEQ ID NO: 1703 - DNA, 15 bp, Homo sapiens
ggcttgatttggagg

SEQ ID NO: 1704 - DNA, 15 bp, Homo sapiens
gcttgatttggaggt

SEQ ID NO: 1705 - DNA, 15 bp, Homo sapiens
cttgatttggaggtt

SEQ ID NO: 1706 - DNA, 15 bp, Homo sapiens
ttgatttggaggtta

SEQ ID NO: 1707 - DNA, 15 bp, Homo sapiens
tgatttggaggttaa

SEQ ID NO: 1708 - DNA, 15 bp, Homo sapiens
gatttggaggttaaa

SEQ ID NO: 1709 - DNA, 15 bp, Homo sapiens
atttggaggttaaag

SEQ ID NO: 1710 - DNA, 15 bp, Homo sapiens
tttggaggttaaagt

SEQ ID NO: 1711 - DNA, 15 bp, Homo sapiens
ttggaggttaaagtt

SEQ ID NO: 1712 - DNA, 15 bp, Homo sapiens
tggaggttaaagttt

SEQ ID NO: 1713 - DNA, 15 bp, Homo sapiens
ggaggttaaagtttt

SEQ ID NO: 1714 - DNA, 15 bp, Homo sapiens
gaggttaaagttttg

SEQ ID NO: 1715 - DNA, 15 bp, Homo sapiens
aggttaaagttttgc

SEQ ID NO: 1716 - DNA, 15 bp, Homo sapiens
ggttaaagttttgct

SEQ ID NO: 1717 - DNA, 15 bp, Homo sapiens
gttaaagttttgcta

SEQ ID NO: 1718 - DNA, 15 bp, Homo sapiens
ttaaagttttgctat

SEQ ID NO: 1719 - DNA, 15 bp, Homo sapiens
taaagttttgctatg

SEQ ID NO: 1720 - DNA, 15 bp, Homo sapiens
aaagttttgctatgc

SEQ ID NO: 1721 - DNA, 15 bp, Homo sapiens
aagttttgctatgct

SEQ ID NO: 1722 - DNA, 15 bp, Homo sapiens
agttttgctatgctg

SEQ ID NO: 1723 - DNA, 15 bp, Homo sapiens
gttttgctatgctgt

SEQ ID NO: 1724 - DNA, 15 bp, Homo sapiens
ttttgctatgctgta

SEQ ID NO: 1725 - DNA, 15 bp, Homo sapiens
tttgctatgctgtat

SEQ ID NO: 1726 - DNA, 15 bp, Homo sapiens
ttgctatgctgtatt

SEQ ID NO: 1727 - DNA, 15 bp, Homo sapiens
tgctatgctgtattt

SEQ ID NO: 1728 - DNA, 15 bp, Homo sapiens
gctatgctgtatttt

SEQ ID NO: 1729 - DNA, 15 bp, Homo sapiens
ctatgctgtatttta

SEQ ID NO: 1730 - DNA, 15 bp, Homo sapiens
tatgctgtattttac

SEQ ID NO: 1731 - DNA, 15 bp, Homo sapiens
atgctgtattttaca

SEQ ID NO: 1732 - DNA, 15 bp, Homo sapiens
tgctgtattttacat

SEQ ID NO: 1733 - DNA, 15 bp, Homo sapiens
gctgtattttacatt

SEQ ID NO: 1734 - DNA, 15 bp, Homo sapiens
ctgtattttacatta

SEQ ID NO: 1735 - DNA, 15 bp, Homo sapiens
tgtattttacattac

SEQ ID NO: 1736 - DNA, 15 bp, Homo sapiens
gtattttacattact

SEQ ID NO: 1737 - DNA, 15 bp, Homo sapiens
tattttacattactt

SEQ ID NO: 1738 - DNA, 15 bp, Homo sapiens
attttacattactta

SEQ ID NO: 1739 - DNA, 15 bp, Homo sapiens
ttttacattacttat

SEQ ID NO: 1740 - DNA, 15 bp, Homo sapiens
tttacattacttatt

SEQ ID NO: 1741 - DNA, 15 bp, Homo sapiens
ttacattacttattg

SEQ ID NO: 1742 - DNA, 15 bp, Homo sapiens
tacattacttattgt

SEQ ID NO: 1743 - DNA, 15 bp, Homo sapiens
acattacttattgtt

SEQ ID NO: 1744 - DNA, 15 bp, Homo sapiens
cattacttattgttt

SEQ ID NO: 1745 - DNA, 15 bp, Homo sapiens
attacttattgtttt

SEQ ID NO: 1746 - DNA, 15 bp, Homo sapiens
ttacttattgtttta

SEQ ID NO: 1747 - DNA, 15 bp, Homo sapiens
tacttattgttttag

SEQ ID NO: 1748 - DNA, 15 bp, Homo sapiens
acttattgttttagc

SEQ ID NO: 1749 - DNA, 15 bp, Homo sapiens
cttattgttttagct

SEQ ID NO: 1750 - DNA, 15 bp, Homo sapiens
ttattgttttagctg

SEQ ID NO: 1751 - DNA, 15 bp, Homo sapiens
tattgttttagctgt

SEQ ID NO: 1752 - DNA, 15 bp, Homo sapiens
attgttttagctgtc

SEQ ID NO: 1753 - DNA, 15 bp, Homo sapiens
ttgttttagctgtcc

SEQ ID NO: 1754 - DNA, 15 bp, Homo sapiens
tgttttagctgtcct

SEQ ID NO: 1755 - DNA, 15 bp, Homo sapiens
gttttagctgtcctc

SEQ ID NO: 1756 - DNA, 15 bp, Homo sapiens
ttttagctgtcctca

SEQ ID NO: 1757 - DNA, 15 bp, Homo sapiens
tttagctgtcctcat

SEQ ID NO: 1758 - DNA, 15 bp, Homo sapiens
ttagctgtcctcatg

SEQ ID NO: 1759 - DNA, 15 bp, Homo sapiens
tagctgtcctcatga

SEQ ID NO: 1760 - DNA, 15 bp, Homo sapiens
agctgtcctcatgaa

SEQ ID NO: 1761 - DNA, 15 bp, Homo sapiens
gctgtcctcatgaat

SEQ ID NO: 1762 - DNA, 15 bp, Homo sapiens
ctgtcctcatgaatg

SEQ ID NO: 1763 - DNA, 15 bp, Homo sapiens
tgtcctcatgaatgt

SEQ ID NO: 1764 - DNA, 15 bp, Homo sapiens
gtcctcatgaatgtc

SEQ ID NO: 1765 - DNA, 15 bp, Homo sapiens
tcctcatgaatgtct

SEQ ID NO: 1766 - DNA, 15 bp, Homo sapiens
cctcatgaatgtctt

SEQ ID NO: 1767 - DNA, 15 bp, Homo sapiens
ctcatgaatgtcttt

SEQ ID NO: 1768 - DNA, 15 bp, Homo sapiens
tcatgaatgtctttt

SEQ ID NO: 1769 - DNA, 15 bp, Homo sapiens
catgaatgtcttttc

SEQ ID NO: 1770 - DNA, 15 bp, Homo sapiens
atgaatgtcttttca

SEQ ID NO: 1771 - DNA, 15 bp, Homo sapiens
tgaatgtcttttcac

SEQ ID NO: 1772 - DNA, 15 bp, Homo sapiens
gaatgtcttttcact

SEQ ID NO: 1773 - DNA, 15 bp, Homo sapiens
aatgtcttttcacta

SEQ ID NO: 1774 - DNA, 15 bp, Homo sapiens
atgtcttttcactac

SEQ ID NO: 1775 - DNA, 15 bp, Homo sapiens
tgtcttttcactacc

SEQ ID NO: 1776 - DNA, 15 bp, Homo sapiens
gtcttttcactaccc

SEQ ID NO: 1777 - DNA, 15 bp, Homo sapiens
tcttttcactaccca

SEQ ID NO: 1778 - DNA, 15 bp, Homo sapiens
cttttcactacccat

SEQ ID NO: 1779 - DNA, 15 bp, Homo sapiens
ttttcactacccatt

SEQ ID NO: 1780 - DNA, 15 bp, Homo sapiens
tttcactacccattt

SEQ ID NO: 1781 - DNA, 15 bp, Homo sapiens
ttcactacccatttg

SEQ ID NO: 1782 - DNA, 15 bp, Homo sapiens
tcactacccatttgc

SEQ ID NO: 1783 - DNA, 15 bp, Homo sapiens
cactacccatttgct

SEQ ID NO: 1784 - DNA, 15 bp, Homo sapiens
actacccatttgctt

SEQ ID NO: 1785 - DNA, 15 bp, Homo sapiens
ctacccatttgctta

SEQ ID NO: 1786 - DNA, 15 bp, Homo sapiens
tacccatttgcttat

SEQ ID NO: 1787 - DNA, 15 bp, Homo sapiens
acccatttgcttatc

SEQ ID NO: 1788 - DNA, 15 bp, Homo sapiens
cccatttgcttatcc

SEQ ID NO: 1789 - DNA, 15 bp, Homo sapiens
ccatttgcttatcct

SEQ ID NO: 1790 - DNA, 15 bp, Homo sapiens
catttgcttatcctg

SEQ ID NO: 1791 - DNA, 15 bp, Homo sapiens
atttgcttatcctgc

SEQ ID NO: 1792 - DNA, 15 bp, Homo sapiens
tttgcttatcctgca

SEQ ID NO: 1793 - DNA, 15 bp, Homo sapiens
ttgcttatcctgcat

SEQ ID NO: 1794 - DNA, 15 bp, Homo sapiens
tgcttatcctgcatc

SEQ ID NO: 1795 - DNA, 15 bp, Homo sapiens
gcttatcctgcatct

SEQ ID NO: 1796 - DNA, 15 bp, Homo sapiens
cttatcctgcatctc

SEQ ID NO: 1797 - DNA, 15 bp, Homo sapiens
ttatcctgcatctct

SEQ ID NO: 1798 - DNA, 15 bp, Homo sapiens
tatcctgcatctctc

SEQ ID NO: 1799 - DNA, 15 bp, Homo sapiens
atcctgcatctctca

SEQ ID NO: 1800 - DNA, 15 bp, Homo sapiens
tcctgcatctctcag

SEQ ID NO: 1801 - DNA, 15 bp, Homo sapiens
cctgcatctctcagc

SEQ ID NO: 1802 - DNA, 15 bp, Homo sapiens
ctgcatctctcagcc

SEQ ID NO: 1803 - DNA, 15 bp, Homo sapiens
tgcatctctcagcct

SEQ ID NO: 1804 - DNA, 15 bp, Homo sapiens
gcatctctcagcctt

SEQ ID NO: 1805 - DNA, 15 bp, Homo sapiens
catctctcagccttg

SEQ ID NO: 1806 - DNA, 15 bp, Homo sapiens
atctctcagccttga

SEQ ID NO: 1807 - DNA, 15 bp, Homo sapiens
tctctcagccttgac

SEQ ID NO: 1808 - DNA, 15 bp, Homo sapiens
ctctcagccttgact

SEQ ID NO: 1809 - DNA, 15 bp, Homo sapiens
tctcagccttgactc

SEQ ID NO: 1810 - DNA, 15 bp, Homo sapiens
ctcagccttgactcc

SEQ ID NO: 1811 - DNA, 15 bp, Homo sapiens
tcagccttgactcca

SEQ ID NO: 1812 - DNA, 15 bp, Homo sapiens
cagccttgactccac

SEQ ID NO: 1813 - DNA, 15 bp, Homo sapiens
agccttgactccact

SEQ ID NO: 1814 - DNA, 15 bp, Homo sapiens
gccttgactccactc

SEQ ID NO: 1815 - DNA, 15 bp, Homo sapiens
ccttgactccactca

SEQ ID NO: 1816 - DNA, 15 bp, Homo sapiens
cttgactccactcag

SEQ ID NO: 1817 - DNA, 15 bp, Homo sapiens
ttgactccactcagt

SEQ ID NO: 1818 - DNA, 15 bp, Homo sapiens
tgactccactcagtt

SEQ ID NO: 1819 - DNA, 15 bp, Homo sapiens
gactccactcagttc

SEQ ID NO: 1820 - DNA, 15 bp, Homo sapiens
actccactcagttct

SEQ ID NO: 1821 - DNA, 15 bp, Homo sapiens
ctccactcagttctc

SEQ ID NO: 1822 - DNA, 15 bp, Homo sapiens
tccactcagttctct

SEQ ID NO: 1823 - DNA, 15 bp, Homo sapiens
ccactcagttctctt

SEQ ID NO: 1824 - DNA, 15 bp, Homo sapiens
cactcagttctcttg

SEQ ID NO: 1825 - DNA, 15 bp, Homo sapiens
actcagttctcttgc

SEQ ID NO: 1826 - DNA, 15 bp, Homo sapiens
ctcagttctcttgct

SEQ ID NO: 1827 - DNA, 15 bp, Homo sapiens
tcagttctcttgctt

SEQ ID NO: 1828 - DNA, 15 bp, Homo sapiens
cagttctcttgctta

SEQ ID NO: 1829 - DNA, 15 bp, Homo sapiens
agttctcttgcttag

SEQ ID NO: 1830 - DNA, 15 bp, Homo sapiens
gttctcttgcttaga

SEQ ID NO: 1831 - DNA, 15 bp, Homo sapiens
ttctcttgcttagag

SEQ ID NO: 1832 - DNA, 15 bp, Homo sapiens
tctcttgcttagaga

SEQ ID NO: 1833 - DNA, 15 bp, Homo sapiens
ctcttgcttagagat

SEQ ID NO: 1834 - DNA, 15 bp, Homo sapiens
tcttgcttagagata

SEQ ID NO: 1835 - DNA, 15 bp, Homo sapiens
cttgcttagagatac

SEQ ID NO: 1836 - DNA, 15 bp, Homo sapiens
ttgcttagagatacc

SEQ ID NO: 1837 - DNA, 15 bp, Homo sapiens
tgcttagagatacca

SEQ ID NO: 1838 - DNA, 15 bp, Homo sapiens
gcttagagataccac

SEQ ID NO: 1839 - DNA, 15 bp, Homo sapiens
cttagagataccacc

SEQ ID NO: 1840 - DNA, 15 bp, Homo sapiens
ttagagataccacct

SEQ ID NO: 1841 - DNA, 15 bp, Homo sapiens
tagagataccacctt

SEQ ID NO: 1842 - DNA, 15 bp, Homo sapiens
agagataccaccttt

SEQ ID NO: 1843 - DNA, 15 bp, Homo sapiens
gagataccacctttc

SEQ ID NO: 1844 - DNA, 15 bp, Homo sapiens
agataccacctttcc

SEQ ID NO: 1845 - DNA, 15 bp, Homo sapiens
gataccacctttccc

SEQ ID NO: 1846 - DNA, 15 bp, Homo sapiens
ataccacctttcccc

SEQ ID NO: 1847 - DNA, 15 bp, Homo sapiens
taccacctttcccct

SEQ ID NO: 1848 - DNA, 15 bp, Homo sapiens
accacctttcccctg

SEQ ID NO: 1849 - DNA, 15 bp, Homo sapiens
ccacctttcccctga

SEQ ID NO: 1850 - DNA, 15 bp, Homo sapiens
cacctttcccctgaa

SEQ ID NO: 1851 - DNA, 15 bp, Homo sapiens
acctttcccctgaag

SEQ ID NO: 1852 - DNA, 15 bp, Homo sapiens
cctttcccctgaagt

SEQ ID NO: 1853 - DNA, 15 bp, Homo sapiens
ctttcccctgaagtg

SEQ ID NO: 1854 - DNA, 15 bp, Homo sapiens
tttcccctgaagtgt

SEQ ID NO: 1855 - DNA, 15 bp, Homo sapiens
ttcccctgaagtgtt

SEQ ID NO: 1856 - DNA, 15 bp, Homo sapiens
tcccctgaagtgttc

SEQ ID NO: 1857 - DNA, 15 bp, Homo sapiens
cccctgaagtgttcc

SEQ ID NO: 1858 - DNA, 15 bp, Homo sapiens
ccctgaagtgttcct

SEQ ID NO: 1859 - DNA, 15 bp, Homo sapiens
cctgaagtgttcctt

SEQ ID NO: 1860 - DNA, 15 bp, Homo sapiens
ctgaagtgttccttc

SEQ ID NO: 1861 - DNA, 15 bp, Homo sapiens
tgaagtgttccttcc

SEQ ID NO: 1862 - DNA, 15 bp, Homo sapiens
gaagtgttccttcca

SEQ ID NO: 1863 - DNA, 15 bp, Homo sapiens
aagtgttccttccat

SEQ ID NO: 1864 - DNA, 15 bp, Homo sapiens
agtgttccttccatg

SEQ ID NO: 1865 - DNA, 15 bp, Homo sapiens
gtgttccttccatgt

SEQ ID NO: 1866 - DNA, 15 bp, Homo sapiens
tgttccttccatgtt

SEQ ID NO: 1867 - DNA, 15 bp, Homo sapiens
gttccttccatgttt

SEQ ID NO: 1868 - DNA, 15 bp, Homo sapiens
ttccttccatgtttt

SEQ ID NO: 1869 - DNA, 15 bp, Homo sapiens
tccttccatgtttta

SEQ ID NO: 1870 - DNA, 15 bp, Homo sapiens
ccttccatgttttac

SEQ ID NO: 1871 - DNA, 15 bp, Homo sapiens
cttccatgttttacg

SEQ ID NO: 1872 - DNA, 15 bp, Homo sapiens
ttccatgttttacgg

SEQ ID NO: 1873 - DNA, 15 bp, Homo sapiens
tccatgttttacggc

SEQ ID NO: 1874 - DNA, 15 bp, Homo sapiens
ccatgttttacggcg

SEQ ID NO: 1875 - DNA, 15 bp, Homo sapiens
catgttttacggcga

SEQ ID NO: 1876 - DNA, 15 bp, Homo sapiens
atgttttacggcgag

SEQ ID NO: 1877 - DNA, 15 bp, Homo sapiens
tgttttacggcgaga

SEQ ID NO: 1878 - DNA, 15 bp, Homo sapiens
gttttacggcgagat

SEQ ID NO: 1879 - DNA, 15 bp, Homo sapiens
ttttacggcgagatg

SEQ ID NO: 1880 - DNA, 15 bp, Homo sapiens
tttacggcgagatgg

SEQ ID NO: 1881 - DNA, 15 bp, Homo sapiens
ttacggcgagatggt

SEQ ID NO: 1882 - DNA, 15 bp, Homo sapiens
tacggcgagatggtt

SEQ ID NO: 1883 - DNA, 15 bp, Homo sapiens
acggcgagatggttt

SEQ ID NO: 1884 - DNA, 15 bp, Homo sapiens
cggcgagatggtttc

SEQ ID NO: 1885 - DNA, 15 bp, Homo sapiens
ggcgagatggtttct

SEQ ID NO: 1886 - DNA, 15 bp, Homo sapiens
gcgagatggtttctc

SEQ ID NO: 1887 - DNA, 15 bp, Homo sapiens
cgagatggtttctcc

SEQ ID NO: 1888 - DNA, 15 bp, Homo sapiens
gagatggtttctcct

SEQ ID NO: 1889 - DNA, 15 bp, Homo sapiens
agatggtttctcctc

SEQ ID NO: 1890 - DNA, 15 bp, Homo sapiens
gatggtttctcctcg

SEQ ID NO: 1891 - DNA, 15 bp, Homo sapiens
atggtttctcctcgc

SEQ ID NO: 1892 - DNA, 15 bp, Homo sapiens
tggtttctcctcgcc

SEQ ID NO: 1893 - DNA, 15 bp, Homo sapiens
ggtttctcctcgcct

SEQ ID NO: 1894 - DNA, 15 bp, Homo sapiens
gtttctcctcgcctg

SEQ ID NO: 1895 - DNA, 15 bp, Homo sapiens
tttctcctcgcctgg

SEQ ID NO: 1896 - DNA, 15 bp, Homo sapiens
ttctcctcgcctggc

SEQ ID NO: 1897 - DNA, 15 bp, Homo sapiens
tctcctcgcctggcc

SEQ ID NO: 1898 - DNA, 15 bp, Homo sapiens
ctcctcgcctggcca

SEQ ID NO: 1899 - DNA, 15 bp, Homo sapiens
tcctcgcctggccac

SEQ ID NO: 1900 - DNA, 15 bp, Homo sapiens
cctcgcctggccact

SEQ ID NO: 1901 - DNA, 15 bp, Homo sapiens
ctcgcctggccactc

SEQ ID NO: 1902 - DNA, 15 bp, Homo sapiens
tcgcctggccactca

SEQ ID NO: 1903 - DNA, 15 bp, Homo sapiens
cgcctggccactcag

SEQ ID NO: 1904 - DNA, 15 bp, Homo sapiens
gcctggccactcagc

SEQ ID NO: 1905 - DNA, 15 bp, Homo sapiens
cctggccactcagcc

SEQ ID NO: 1906 - DNA, 15 bp, Homo sapiens
ctggccactcagcct

SEQ ID NO: 1907 - DNA, 15 bp, Homo sapiens
tggccactcagcctt

SEQ ID NO: 1908 - DNA, 15 bp, Homo sapiens
ggccactcagcctta

SEQ ID NO: 1909 - DNA, 15 bp, Homo sapiens
gccactcagccttag

SEQ ID NO: 1910 - DNA, 15 bp, Homo sapiens
ccactcagccttagt

SEQ ID NO: 1911 - DNA, 15 bp, Homo sapiens
cactcagccttagtt

SEQ ID NO: 1912 - DNA, 15 bp, Homo sapiens
actcagccttagttg

SEQ ID NO: 1913 - DNA, 15 bp, Homo sapiens
ctcagccttagttgt

SEQ ID NO: 1914 - DNA, 15 bp, Homo sapiens
tcagccttagttgtc

SEQ ID NO: 1915 - DNA, 15 bp, Homo sapiens
cagccttagttgtct

SEQ ID NO: 1916 - DNA, 15 bp, Homo sapiens
agccttagttgtctc

SEQ ID NO: 1917 - DNA, 15 bp, Homo sapiens
gccttagttgtctct

SEQ ID NO: 1918 - DNA, 15 bp, Homo sapiens
ccttagttgtctctg

SEQ ID NO: 1919 - DNA, 15 bp, Homo sapiens
cttagttgtctctgt

SEQ ID NO: 1920 - DNA, 15 bp, Homo sapiens
ttagttgtctctgtt

SEQ ID NO: 1921 - DNA, 15 bp, Homo sapiens
tagttgtctctgttg

SEQ ID NO: 1922 - DNA, 15 bp, Homo sapiens
agttgtctctgttgt

SEQ ID NO: 1923 - DNA, 15 bp, Homo sapiens
gttgtctctgttgtc

SEQ ID NO: 1924 - DNA, 15 bp, Homo sapiens
ttgtctctgttgtct

SEQ ID NO: 1925 - DNA, 15 bp, Homo sapiens
tgtctctgttgtctt

SEQ ID NO: 1926 - DNA, 15 bp, Homo sapiens
gtctctgttgtctta

SEQ ID NO: 1927 - DNA, 15 bp, Homo sapiens
tctctgttgtcttat

SEQ ID NO: 1928 - DNA, 15 bp, Homo sapiens
ctctgttgtcttata

SEQ ID NO: 1929 - DNA, 15 bp, Homo sapiens
tctgttgtcttatag

SEQ ID NO: 1930 - DNA, 15 bp, Homo sapiens
ctgttgtcttataga

SEQ ID NO: 1931 - DNA, 15 bp, Homo sapiens
tgttgtcttatagag

SEQ ID NO: 1932 - DNA, 15 bp, Homo sapiens
gttgtcttatagagg

SEQ ID NO: 1933 - DNA, 15 bp, Homo sapiens
ttgtcttatagaggt

SEQ ID NO: 1934 - DNA, 15 bp, Homo sapiens
tgtcttatagaggtc

SEQ ID NO: 1935 - DNA, 15 bp, Homo sapiens
gtcttatagaggtct

SEQ ID NO: 1936 - DNA, 15 bp, Homo sapiens
tcttatagaggtcta

SEQ ID NO: 1937 - DNA, 15 bp, Homo sapiens
cttatagaggtctac

SEQ ID NO: 1938 - DNA, 15 bp, Homo sapiens
ttatagaggtctact

SEQ ID NO: 1939 - DNA, 15 bp, Homo sapiens
tatagaggtctactt

SEQ ID NO: 1940 - DNA, 15 bp, Homo sapiens
atagaggtctacttg

SEQ ID NO: 1941 - DNA, 15 bp, Homo sapiens
tagaggtctacttga

SEQ ID NO: 1942 - DNA, 15 bp, Homo sapiens
agaggtctacttgaa

SEQ ID NO: 1943 - DNA, 15 bp, Homo sapiens
gaggtctacttgaag

SEQ ID NO: 1944 - DNA, 15 bp, Homo sapiens
aggtctacttgaaga

SEQ ID NO: 1945 - DNA, 15 bp, Homo sapiens
ggtctacttgaagaa

SEQ ID NO: 1946 - DNA, 15 bp, Homo sapiens
gtctacttgaagaag

SEQ ID NO: 1947 - DNA, 15 bp, Homo sapiens
tctacttgaagaagg

SEQ ID NO: 1948 - DNA, 15 bp, Homo sapiens
ctacttgaagaagga

SEQ ID NO: 1949 - DNA, 15 bp, Homo sapiens
tacttgaagaaggaa

SEQ ID NO: 1950 - DNA, 15 bp, Homo sapiens
acttgaagaaggaaa

SEQ ID NO: 1951 - DNA, 15 bp, Homo sapiens
cttgaagaaggaaaa

SEQ ID NO: 1952 - DNA, 15 bp, Homo sapiens
ttgaagaaggaaaaa

SEQ ID NO: 1953 - DNA, 15 bp, Homo sapiens
tgaagaaggaaaaac

SEQ ID NO: 1954 - DNA, 15 bp, Homo sapiens
gaagaaggaaaaaca

SEQ ID NO: 1955 - DNA, 15 bp, Homo sapiens
aagaaggaaaaacag

SEQ ID NO: 1956 - DNA, 15 bp, Homo sapiens
agaaggaaaaacagg

SEQ ID NO: 1957 - DNA, 15 bp, Homo sapiens
gaaggaaaaacaggg

SEQ ID NO: 1958 - DNA, 15 bp, Homo sapiens
aaggaaaaacagggg

SEQ ID NO: 1959 - DNA, 15 bp, Homo sapiens
aggaaaaacaggggt

SEQ ID NO: 1960 - DNA, 15 bp, Homo sapiens
ggaaaaacaggggtc

SEQ ID NO: 1961 - DNA, 15 bp, Homo sapiens
gaaaaacaggggtca

SEQ ID NO: 1962 - DNA, 15 bp, Homo sapiens
aaaaacaggggtcat

SEQ ID NO: 1963 - DNA, 15 bp, Homo sapiens
aaaacaggggtcatg

SEQ ID NO: 1964 - DNA, 15 bp, Homo sapiens
aaacaggggtcatgg

SEQ ID NO: 1965 - DNA, 15 bp, Homo sapiens
aacaggggtcatggt

SEQ ID NO: 1966 - DNA, 15 bp, Homo sapiens
acaggggtcatggtt

SEQ ID NO: 1967 - DNA, 15 bp, Homo sapiens
caggggtcatggttt

SEQ ID NO: 1968 - DNA, 15 bp, Homo sapiens
aggggtcatggtttg

SEQ ID NO: 1969 - DNA, 15 bp, Homo sapiens
ggggtcatggtttga

SEQ ID NO: 1970 - DNA, 15 bp, Homo sapiens
gggtcatggtttgac

SEQ ID NO: 1971 - DNA, 15 bp, Homo sapiens
ggtcatggtttgact

SEQ ID NO: 1972 - DNA, 15 bp, Homo sapiens
gtcatggtttgactg

SEQ ID NO: 1973 - DNA, 15 bp, Homo sapiens
tcatggtttgactgt

SEQ ID NO: 1974 - DNA, 15 bp, Homo sapiens
catggtttgactgtc

SEQ ID NO: 1975 - DNA, 15 bp, Homo sapiens
atggtttgactgtcc

SEQ ID NO: 1976 - DNA, 15 bp, Homo sapiens
tggtttgactgtcct

SEQ ID NO: 1977 - DNA, 15 bp, Homo sapiens
ggtttgactgtcctg

SEQ ID NO: 1978 - DNA, 15 bp, Homo sapiens
gtttgactgtcctgt

SEQ ID NO: 1979 - DNA, 15 bp, Homo sapiens
tttgactgtcctgtg

SEQ ID NO: 1980 - DNA, 15 bp, Homo sapiens
ttgactgtcctgtga

SEQ ID NO: 1981 - DNA, 15 bp, Homo sapiens
tgactgtcctgtgag

SEQ ID NO: 1982 - DNA, 15 bp, Homo sapiens
gactgtcctgtgagc

SEQ ID NO: 1983 - DNA, 15 bp, Homo sapiens
actgtcctgtgagcc

SEQ ID NO: 1984 - DNA, 15 bp, Homo sapiens
ctgtcctgtgagccc

SEQ ID NO: 1985 - DNA, 15 bp, Homo sapiens
tgtcctgtgagccct

SEQ ID NO: 1986 - DNA, 15 bp, Homo sapiens
gtcctgtgagccctt

SEQ ID NO: 1987 - DNA, 15 bp, Homo sapiens
tcctgtgagcccttc

SEQ ID NO: 1988 - DNA, 15 bp, Homo sapiens
cctgtgagcccttct

SEQ ID NO: 1989 - DNA, 15 bp, Homo sapiens
ctgtgagcccttctt

SEQ ID NO: 1990 - DNA, 15 bp, Homo sapiens
tgtgagcccttcttc

SEQ ID NO: 1991 - DNA, 15 bp, Homo sapiens
gtgagcccttcttcc

SEQ ID NO: 1992 - DNA, 15 bp, Homo sapiens
tgagcccttcttccc

SEQ ID NO: 1993 - DNA, 15 bp, Homo sapiens
gagcccttcttccct

SEQ ID NO: 1994 - DNA, 15 bp, Homo sapiens
agcccttcttccctg

SEQ ID NO: 1995 - DNA, 15 bp, Homo sapiens
gcccttcttccctgc

SEQ ID NO: 1996 - DNA, 15 bp, Homo sapiens
cccttcttccctgcc

SEQ ID NO: 1997 - DNA, 15 bp, Homo sapiens
ccttcttccctgcct

SEQ ID NO: 1998 - DNA, 15 bp, Homo sapiens
cttcttccctgcctc

SEQ ID NO: 1999 - DNA, 15 bp, Homo sapiens
ttcttccctgcctcc

SEQ ID NO: 2000 - DNA, 15 bp, Homo sapiens
tcttccctgcctccc

SEQ ID NO: 2001 - DNA, 15 bp, Homo sapiens
cttccctgcctcccc

SEQ ID NO: 2002 - DNA, 15 bp, Homo sapiens
ttccctgcctccccc

SEQ ID NO: 2003 - DNA, 15 bp, Homo sapiens
tccctgcctccccca

SEQ ID NO: 2004 - DNA, 15 bp, Homo sapiens
ccctgcctcccccac

SEQ ID NO: 2005 - DNA, 15 bp, Homo sapiens
cctgcctcccccact

SEQ ID NO: 2006 - DNA, 15 bp, Homo sapiens
ctgcctcccccactc

SEQ ID NO: 2007 - DNA, 15 bp, Homo sapiens
tgcctcccccactca

SEQ ID NO: 2008 - DNA, 15 bp, Homo sapiens
gcctcccccactcac

SEQ ID NO: 2009 - DNA, 15 bp, Homo sapiens
cctcccccactcaca

SEQ ID NO: 2010 - DNA, 15 bp, Homo sapiens
ctcccccactcacag

SEQ ID NO: 2011 - DNA, 15 bp, Homo sapiens
tcccccactcacagt

SEQ ID NO: 2012 - DNA, 15 bp, Homo sapiens
cccccactcacagtg

SEQ ID NO: 2013 - DNA, 15 bp, Homo sapiens
ccccactcacagtga

SEQ ID NO: 2014 - DNA, 15 bp, Homo sapiens
cccactcacagtgac

SEQ ID NO: 2015 - DNA, 15 bp, Homo sapiens
ccactcacagtgacc

SEQ ID NO: 2016 - DNA, 15 bp, Homo sapiens
cactcacagtgaccc

SEQ ID NO: 2017 - DNA, 15 bp, Homo sapiens
actcacagtgacccg

SEQ ID NO: 2018 - DNA, 15 bp, Homo sapiens
ctcacagtgacccgg

SEQ ID NO: 2019 - DNA, 15 bp, Homo sapiens
tcacagtgacccgga

SEQ ID NO: 2020 - DNA, 15 bp, Homo sapiens
cacagtgacccggaa

SEQ ID NO: 2021 - DNA, 15 bp, Homo sapiens
acagtgacccggaat

SEQ ID NO: 2022 - DNA, 15 bp, Homo sapiens
cagtgacccggaatc

SEQ ID NO: 2023 - DNA, 15 bp, Homo sapiens
agtgacccggaatct

SEQ ID NO: 2024 - DNA, 15 bp, Homo sapiens
gtgacccggaatctg

SEQ ID NO: 2025 - DNA, 15 bp, Homo sapiens
tgacccggaatctgc

SEQ ID NO: 2026 - DNA, 15 bp, Homo sapiens
gacccggaatctgca

SEQ ID NO: 2027 - DNA, 15 bp, Homo sapiens
acccggaatctgcag

SEQ ID NO: 2028 - DNA, 15 bp, Homo sapiens
cccggaatctgcagt

SEQ ID NO: 2029 - DNA, 15 bp, Homo sapiens
ccggaatctgcagtg

SEQ ID NO: 2030 - DNA, 15 bp, Homo sapiens
cggaatctgcagtgc

SEQ ID NO: 2031 - DNA, 15 bp, Homo sapiens
ggaatctgcagtgct

SEQ ID NO: 2032 - DNA, 15 bp, Homo sapiens
gaatctgcagtgcta

SEQ ID NO: 2033 - DNA, 15 bp, Homo sapiens
aatctgcagtgctag

SEQ ID NO: 2034 - DNA, 15 bp, Homo sapiens
atctgcagtgctagt

SEQ ID NO: 2035 - DNA, 15 bp, Homo sapiens
tctgcagtgctagtc

SEQ ID NO: 2036 - DNA, 15 bp, Homo sapiens
ctgcagtgctagtct

SEQ ID NO: 2037 - DNA, 15 bp, Homo sapiens
tgcagtgctagtctc

SEQ ID NO: 2038 - DNA, 15 bp, Homo sapiens
gcagtgctagtctcc

SEQ ID NO: 2039 - DNA, 15 bp, Homo sapiens
cagtgctagtctccc

SEQ ID NO: 2040 - DNA, 15 bp, Homo sapiens
agtgctagtctcccg

SEQ ID NO: 2041 - DNA, 15 bp, Homo sapiens
gtgctagtctcccgg

SEQ ID NO: 2042 - DNA, 15 bp, Homo sapiens
tgctagtctcccgga

SEQ ID NO: 2043 - DNA, 15 bp, Homo sapiens
gctagtctcccggaa

SEQ ID NO: 2044 - DNA, 15 bp, Homo sapiens
ctagtctcccggaac

SEQ ID NO: 2045 - DNA, 15 bp, Homo sapiens
tagtctcccggaact

SEQ ID NO: 2046 - DNA, 15 bp, Homo sapiens
agtctcccggaacta

SEQ ID NO: 2047 - DNA, 15 bp, Homo sapiens
gtctcccggaactat

SEQ ID NO: 2048 - DNA, 15 bp, Homo sapiens
tctcccggaactatc

SEQ ID NO: 2049 - DNA, 15 bp, Homo sapiens
ctcccggaactatca

SEQ ID NO: 2050 - DNA, 15 bp, Homo sapiens
tcccggaactatcac

SEQ ID NO: 2051 - DNA, 15 bp, Homo sapiens
cccggaactatcact

SEQ ID NO: 2052 - DNA, 15 bp, Homo sapiens
ccggaactatcactc

SEQ ID NO: 2053 - DNA, 15 bp, Homo sapiens
cggaactatcactct

SEQ ID NO: 2054 - DNA, 15 bp, Homo sapiens
ggaactatcactctt

SEQ ID NO: 2055 - DNA, 15 bp, Homo sapiens
gaactatcactcttt

SEQ ID NO: 2056 - DNA, 15 bp, Homo sapiens
aactatcactctttc

SEQ ID NO: 2057 - DNA, 15 bp, Homo sapiens
actatcactctttca

SEQ ID NO: 2058 - DNA, 15 bp, Homo sapiens
ctatcactctttcac

SEQ ID NO: 2059 - DNA, 15 bp, Homo sapiens
tatcactctttcaca

SEQ ID NO: 2060 - DNA, 15 bp, Homo sapiens
atcactctttcacag

SEQ ID NO: 2061 - DNA, 15 bp, Homo sapiens
tcactctttcacagt

SEQ ID NO: 2062 - DNA, 15 bp, Homo sapiens
cactctttcacagtc

SEQ ID NO: 2063 - DNA, 15 bp, Homo sapiens
actctttcacagtct

SEQ ID NO: 2064 - DNA, 15 bp, Homo sapiens
ctctttcacagtctg

SEQ ID NO: 2065 - DNA, 15 bp, Homo sapiens
tctttcacagtctgc

SEQ ID NO: 2066 - DNA, 15 bp, Homo sapiens
ctttcacagtctgct

SEQ ID NO: 2067 - DNA, 15 bp, Homo sapiens
tttcacagtctgctt

SEQ ID NO: 2068 - DNA, 15 bp, Homo sapiens
ttcacagtctgcttt

SEQ ID NO: 2069 - DNA, 15 bp, Homo sapiens
tcacagtctgctttg

SEQ ID NO: 2070 - DNA, 15 bp, Homo sapiens
cacagtctgctttgg

SEQ ID NO: 2071 - DNA, 15 bp, Homo sapiens
acagtctgctttgga

SEQ ID NO: 2072 - DNA, 15 bp, Homo sapiens
cagtctgctttggaa

SEQ ID NO: 2073 - DNA, 15 bp, Homo sapiens
agtctgctttggaag

SEQ ID NO: 2074 - DNA, 15 bp, Homo sapiens
gtctgctttggaagg

SEQ ID NO: 2075 - DNA, 15 bp, Homo sapiens
tctgctttggaagga

SEQ ID NO: 2076 - DNA, 15 bp, Homo sapiens
ctgctttggaaggac

SEQ ID NO: 2077 - DNA, 15 bp, Homo sapiens
tgctttggaaggact

SEQ ID NO: 2078 - DNA, 15 bp, Homo sapiens
gctttggaaggactg

SEQ ID NO: 2079 - DNA, 15 bp, Homo sapiens
ctttggaaggactgg

SEQ ID NO: 2080 - DNA, 15 bp, Homo sapiens
tttggaaggactggg

SEQ ID NO: 2081 - DNA, 15 bp, Homo sapiens
ttggaaggactgggc

SEQ ID NO: 2082 - DNA, 15 bp, Homo sapiens
tggaaggactgggct

SEQ ID NO: 2083 - DNA, 15 bp, Homo sapiens
ggaaggactgggctt

SEQ ID NO: 2084 - DNA, 15 bp, Homo sapiens
gaaggactgggctta

SEQ ID NO: 2085 - DNA, 15 bp, Homo sapiens
aaggactgggcttag

SEQ ID NO: 2086 - DNA, 15 bp, Homo sapiens
aggactgggcttagt

SEQ ID NO: 2087 - DNA, 15 bp, Homo sapiens
ggactgggcttagta

SEQ ID NO: 2088 - DNA, 15 bp, Homo sapiens
gactgggcttagtat

SEQ ID NO: 2089 - DNA, 15 bp, Homo sapiens
actgggcttagtatg

SEQ ID NO: 2090 - DNA, 15 bp, Homo sapiens
ctgggcttagtatga

SEQ ID NO: 2091 - DNA, 15 bp, Homo sapiens
tgggcttagtatgaa

SEQ ID NO: 2092 - DNA, 15 bp, Homo sapiens
gggcttagtatgaaa

SEQ ID NO: 2093 - DNA, 15 bp, Homo sapiens
ggcttagtatgaaaa

SEQ ID NO: 2094 - DNA, 15 bp, Homo sapiens
gcttagtatgaaaag

SEQ ID NO: 2095 - DNA, 15 bp, Homo sapiens
cttagtatgaaaagt

SEQ ID NO: 2096 - DNA, 15 bp, Homo sapiens
ttagtatgaaaagtt

SEQ ID NO: 2097 - DNA, 15 bp, Homo sapiens
tagtatgaaaagtta

SEQ ID NO: 2098 - DNA, 15 bp, Homo sapiens
agtatgaaaagttag

SEQ ID NO: 2099 - DNA, 15 bp, Homo sapiens
gtatgaaaagttagg

SEQ ID NO: 2100 - DNA, 15 bp, Homo sapiens
tatgaaaagttagga

SEQ ID NO: 2101 - DNA, 15 bp, Homo sapiens
atgaaaagttaggac

SEQ ID NO: 2102 - DNA, 15 bp, Homo sapiens
tgaaaagttaggact

SEQ ID NO: 2103 - DNA, 15 bp, Homo sapiens
gaaaagttaggactg

SEQ ID NO: 2104 - DNA, 15 bp, Homo sapiens
aaaagttaggactga

SEQ ID NO: 2105 - DNA, 15 bp, Homo sapiens
aaagttaggactgag

SEQ ID NO: 2106 - DNA, 15 bp, Homo sapiens
aagttaggactgaga

SEQ ID NO: 2107 - DNA, 15 bp, Homo sapiens
agttaggactgagaa

SEQ ID NO: 2108 - DNA, 15 bp, Homo sapiens
gttaggactgagaag

SEQ ID NO: 2109 - DNA, 15 bp, Homo sapiens
ttaggactgagaaga

SEQ ID NO: 2110 - DNA, 15 bp, Homo sapiens
taggactgagaagaa

SEQ ID NO: 2111 - DNA, 15 bp, Homo sapiens
aggactgagaagaat

SEQ ID NO: 2112 - DNA, 15 bp, Homo sapiens
ggactgagaagaatt

SEQ ID NO: 2113 - DNA, 15 bp, Homo sapiens
gactgagaagaattt

SEQ ID NO: 2114 - DNA, 15 bp, Homo sapiens
actgagaagaatttg

SEQ ID NO: 2115 - DNA, 15 bp, Homo sapiens
ctgagaagaatttga

SEQ ID NO: 2116 - DNA, 15 bp, Homo sapiens
tgagaagaatttgaa

SEQ ID NO: 2117 - DNA, 15 bp, Homo sapiens
gagaagaatttgaaa

SEQ ID NO: 2118 - DNA, 15 bp, Homo sapiens
agaagaatttgaaag

SEQ ID NO: 2119 - DNA, 15 bp, Homo sapiens
gaagaatttgaaagg

SEQ ID NO: 2120 - DNA, 15 bp, Homo sapiens
aagaatttgaaaggc

SEQ ID NO: 2121 - DNA, 15 bp, Homo sapiens
agaatttgaaaggcg

SEQ ID NO: 2122 - DNA, 15 bp, Homo sapiens
gaatttgaaaggcgg

SEQ ID NO: 2123 - DNA, 15 bp, Homo sapiens
aatttgaaaggcggc

SEQ ID NO: 2124 - DNA, 15 bp, Homo sapiens
atttgaaaggcggct

SEQ ID NO: 2125 - DNA, 15 bp, Homo sapiens
tttgaaaggcggctt

SEQ ID NO: 2126 - DNA, 15 bp, Homo sapiens
ttgaaaggcggcttt

SEQ ID NO: 2127 - DNA, 15 bp, Homo sapiens
tgaaaggcggctttt

SEQ ID NO: 2128 - DNA, 15 bp, Homo sapiens
gaaaggcggcttttt

SEQ ID NO: 2129 - DNA, 15 bp, Homo sapiens
aaaggcggctttttg

SEQ ID NO: 2130 - DNA, 15 bp, Homo sapiens
aaggcggctttttgt

SEQ ID NO: 2131 - DNA, 15 bp, Homo sapiens
aggcggctttttgta

SEQ ID NO: 2132 - DNA, 15 bp, Homo sapiens
ggcggctttttgtag

SEQ ID NO: 2133 - DNA, 15 bp, Homo sapiens
gcggctttttgtagc

SEQ ID NO: 2134 - DNA, 15 bp, Homo sapiens
cggctttttgtagct

SEQ ID NO: 2135 - DNA, 15 bp, Homo sapiens
ggctttttgtagctt

SEQ ID NO: 2136 - DNA, 15 bp, Homo sapiens
gctttttgtagcttg

SEQ ID NO: 2137 - DNA, 15 bp, Homo sapiens
ctttttgtagcttga

SEQ ID NO: 2138 - DNA, 15 bp, Homo sapiens
tttttgtagcttgat

SEQ ID NO: 2139 - DNA, 15 bp, Homo sapiens
ttttgtagcttgata

SEQ ID NO: 2140 - DNA, 15 bp, Homo sapiens
tttgtagcttgatat

SEQ ID NO: 2141 - DNA, 15 bp, Homo sapiens
ttgtagcttgatatt

SEQ ID NO: 2142 - DNA, 15 bp, Homo sapiens
tgtagcttgatattc

SEQ ID NO: 2143 - DNA, 15 bp, Homo sapiens
gtagcttgatattca

SEQ ID NO: 2144 - DNA, 15 bp, Homo sapiens
tagcttgatattcac

SEQ ID NO: 2145 - DNA, 15 bp, Homo sapiens
agcttgatattcact

SEQ ID NO: 2146 - DNA, 15 bp, Homo sapiens
gcttgatattcacta

SEQ ID NO: 2147 - DNA, 15 bp, Homo sapiens
cttgatattcactac

SEQ ID NO: 2148 - DNA, 15 bp, Homo sapiens
ttgatattcactact

SEQ ID NO: 2149 - DNA, 15 bp, Homo sapiens
tgatattcactactg

SEQ ID NO: 2150 - DNA, 15 bp, Homo sapiens
gatattcactactgt

SEQ ID NO: 2151 - DNA, 15 bp, Homo sapiens
atattcactactgtc

SEQ ID NO: 2152 - DNA, 15 bp, Homo sapiens
tattcactactgtct

SEQ ID NO: 2153 - DNA, 15 bp, Homo sapiens
attcactactgtctt

SEQ ID NO: 2154 - DNA, 15 bp, Homo sapiens
ttcactactgtctta

SEQ ID NO: 2155 - DNA, 15 bp, Homo sapiens
tcactactgtcttat

SEQ ID NO: 2156 - DNA, 15 bp, Homo sapiens
cactactgtcttatt

SEQ ID NO: 2157 - DNA, 15 bp, Homo sapiens
actactgtcttatta

SEQ ID NO: 2158 - DNA, 15 bp, Homo sapiens
ctactgtcttattac

SEQ ID NO: 2159 - DNA, 15 bp, Homo sapiens
tactgtcttattacc

SEQ ID NO: 2160 - DNA, 15 bp, Homo sapiens
actgtcttattaccc

SEQ ID NO: 2161 - DNA, 15 bp, Homo sapiens
ctgtcttattaccct

SEQ ID NO: 2162 - DNA, 15 bp, Homo sapiens
tgtcttattaccctg

SEQ ID NO: 2163 - DNA, 15 bp, Homo sapiens
gtcttattaccctgt

SEQ ID NO: 2164 - DNA, 15 bp, Homo sapiens
tcttattaccctgtc

SEQ ID NO: 2165 - DNA, 15 bp, Homo sapiens
cttattaccctgtca

SEQ ID NO: 2166 - DNA, 15 bp, Homo sapiens
ttattaccctgtcat

SEQ ID NO: 2167 - DNA, 15 bp, Homo sapiens
tattaccctgtcata

SEQ ID NO: 2168 - DNA, 15 bp, Homo sapiens
attaccctgtcatag

SEQ ID NO: 2169 - DNA, 15 bp, Homo sapiens
ttaccctgtcatagg

SEQ ID NO: 2170 - DNA, 15 bp, Homo sapiens
taccctgtcataggc

SEQ ID NO: 2171 - DNA, 15 bp, Homo sapiens
accctgtcataggcc

SEQ ID NO: 2172 - DNA, 15 bp, Homo sapiens
ccctgtcataggccc

SEQ ID NO: 2173 - DNA, 15 bp, Homo sapiens
cctgtcataggccca

SEQ ID NO: 2174 - DNA, 15 bp, Homo sapiens
ctgtcataggcccac

SEQ ID NO: 2175 - DNA, 15 bp, Homo sapiens
tgtcataggcccacc

SEQ ID NO: 2176 - DNA, 15 bp, Homo sapiens
gtcataggcccaccc

SEQ ID NO: 2177 - DNA, 15 bp, Homo sapiens
tcataggcccacccc

SEQ ID NO: 2178 - DNA, 15 bp, Homo sapiens
cataggcccacccca

SEQ ID NO: 2179 - DNA, 15 bp, Homo sapiens
ataggcccaccccaa

SEQ ID NO: 2180 - DNA, 15 bp, Homo sapiens
taggcccaccccaaa

SEQ ID NO: 2181 - DNA, 15 bp, Homo sapiens
aggcccaccccaaat

SEQ ID NO: 2182 - DNA, 15 bp, Homo sapiens
ggcccaccccaaatg

SEQ ID NO: 2183 - DNA, 15 bp, Homo sapiens
gcccaccccaaatgg

SEQ ID NO: 2184 - DNA, 15 bp, Homo sapiens
cccaccccaaatgga

SEQ ID NO: 2185 - DNA, 15 bp, Homo sapiens
ccaccccaaatggaa

SEQ ID NO: 2186 - DNA, 15 bp, Homo sapiens
caccccaaatggaag

SEQ ID NO: 2187 - DNA, 15 bp, Homo sapiens
accccaaatggaagt

SEQ ID NO: 2188 - DNA, 15 bp, Homo sapiens
ccccaaatggaagtc

SEQ ID NO: 2189 - DNA, 15 bp, Homo sapiens
cccaaatggaagtcc

SEQ ID NO: 2190 - DNA, 15 bp, Homo sapiens
ccaaatggaagtccc

SEQ ID NO: 2191 - DNA, 15 bp, Homo sapiens
caaatggaagtccca

SEQ ID NO: 2192 - DNA, 15 bp, Homo sapiens
aaatggaagtcccat

SEQ ID NO: 2193 - DNA, 15 bp, Homo sapiens
aatggaagtcccatt

SEQ ID NO: 2194 - DNA, 15 bp, Homo sapiens
atggaagtcccattc

SEQ ID NO: 2195 - DNA, 15 bp, Homo sapiens
tggaagtcccattct

SEQ ID NO: 2196 - DNA, 15 bp, Homo sapiens
ggaagtcccattctt

SEQ ID NO: 2197 - DNA, 15 bp, Homo sapiens
gaagtcccattcttc

SEQ ID NO: 2198 - DNA, 15 bp, Homo sapiens
aagtcccattcttcc

SEQ ID NO: 2199 - DNA, 15 bp, Homo sapiens
agtcccattcttcct

SEQ ID NO: 2200 - DNA, 15 bp, Homo sapiens
gtcccattcttcctc

SEQ ID NO: 2201 - DNA, 15 bp, Homo sapiens
tcccattcttcctca

SEQ ID NO: 2202 - DNA, 15 bp, Homo sapiens
cccattcttcctcag

SEQ ID NO: 2203 - DNA, 15 bp, Homo sapiens
ccattcttcctcagg

SEQ ID NO: 2204 - DNA, 15 bp, Homo sapiens
cattcttcctcagga

SEQ ID NO: 2205 - DNA, 15 bp, Homo sapiens
attcttcctcaggat

SEQ ID NO: 2206 - DNA, 15 bp, Homo sapiens
ttcttcctcaggatg

SEQ ID NO: 2207 - DNA, 15 bp, Homo sapiens
tcttcctcaggatgt

SEQ ID NO: 2208 - DNA, 15 bp, Homo sapiens
cttcctcaggatgtt

SEQ ID NO: 2209 - DNA, 15 bp, Homo sapiens
ttcctcaggatgttt

SEQ ID NO: 2210 - DNA, 15 bp, Homo sapiens
tcctcaggatgttta

SEQ ID NO: 2211 - DNA, 15 bp, Homo sapiens
cctcaggatgtttaa

SEQ ID NO: 2212 - DNA, 15 bp, Homo sapiens
ctcaggatgtttaag

SEQ ID NO: 2213 - DNA, 15 bp, Homo sapiens
tcaggatgtttaaga

SEQ ID NO: 2214 - DNA, 15 bp, Homo sapiens
caggatgtttaagat

SEQ ID NO: 2215 - DNA, 15 bp, Homo sapiens
aggatgtttaagatt

SEQ ID NO: 2216 - DNA, 15 bp, Homo sapiens
ggatgtttaagatta

SEQ ID NO: 2217 - DNA, 15 bp, Homo sapiens
gatgtttaagattag

SEQ ID NO: 2218 - DNA, 15 bp, Homo sapiens
atgtttaagattagc

SEQ ID NO: 2219 - DNA, 15 bp, Homo sapiens
tgtttaagattagca

SEQ ID NO: 2220 - DNA, 15 bp, Homo sapiens
gtttaagattagcat

SEQ ID NO: 2221 - DNA, 15 bp, Homo sapiens
tttaagattagcatt

SEQ ID NO: 2222 - DNA, 15 bp, Homo sapiens
ttaagattagcattc

SEQ ID NO: 2223 - DNA, 15 bp, Homo sapiens
taagattagcattca

SEQ ID NO: 2224 - DNA, 15 bp, Homo sapiens
aagattagcattcag

SEQ ID NO: 2225 - DNA, 15 bp, Homo sapiens
agattagcattcagg

SEQ ID NO: 2226 - DNA, 15 bp, Homo sapiens
gattagcattcagga

SEQ ID NO: 2227 - DNA, 15 bp, Homo sapiens
attagcattcaggaa

SEQ ID NO: 2228 - DNA, 15 bp, Homo sapiens
ttagcattcaggaag

SEQ ID NO: 2229 - DNA, 15 bp, Homo sapiens
tagcattcaggaaga

SEQ ID NO: 2230 - DNA, 15 bp, Homo sapiens
agcattcaggaagag

SEQ ID NO: 2231 - DNA, 15 bp, Homo sapiens
gcattcaggaagaga

SEQ ID NO: 2232 - DNA, 15 bp, Homo sapiens
cattcaggaagagat

SEQ ID NO: 2233 - DNA, 15 bp, Homo sapiens
attcaggaagagatc

SEQ ID NO: 2234 - DNA, 15 bp, Homo sapiens
ttcaggaagagatca

SEQ ID NO: 2235 - DNA, 15 bp, Homo sapiens
tcaggaagagatcag

SEQ ID NO: 2236 - DNA, 15 bp, Homo sapiens
caggaagagatcaga

SEQ ID NO: 2237 - DNA, 15 bp, Homo sapiens
aggaagagatcagag

SEQ ID NO: 2238 - DNA, 15 bp, Homo sapiens
ggaagagatcagagg

SEQ ID NO: 2239 - DNA, 15 bp, Homo sapiens
gaagagatcagaggt

SEQ ID NO: 2240 - DNA, 15 bp, Homo sapiens
aagagatcagaggtc

SEQ ID NO: 2241 - DNA, 15 bp, Homo sapiens
agagatcagaggtct

SEQ ID NO: 2242 - DNA, 15 bp, Homo sapiens
gagatcagaggtctg

SEQ ID NO: 2243 - DNA, 15 bp, Homo sapiens
agatcagaggtctgc

SEQ ID NO: 2244 - DNA, 15 bp, Homo sapiens
gatcagaggtctgct

SEQ ID NO: 2245 - DNA, 15 bp, Homo sapiens
atcagaggtctgctg

SEQ ID NO: 2246 - DNA, 15 bp, Homo sapiens
tcagaggtctgctgg

SEQ ID NO: 2247 - DNA, 15 bp, Homo sapiens
cagaggtctgctggc

SEQ ID NO: 2248 - DNA, 15 bp, Homo sapiens
agaggtctgctggct

SEQ ID NO: 2249 - DNA, 15 bp, Homo sapiens
gaggtctgctggctc

SEQ ID NO: 2250 - DNA, 15 bp, Homo sapiens
aggtctgctggctcc

SEQ ID NO: 2251 - DNA, 15 bp, Homo sapiens
ggtctgctggctccc

SEQ ID NO: 2252 - DNA, 15 bp, Homo sapiens
gtctgctggctccct

SEQ ID NO: 2253 - DNA, 15 bp, Homo sapiens
tctgctggctccctt

SEQ ID NO: 2254 - DNA, 15 bp, Homo sapiens
ctgctggctccctta

SEQ ID NO: 2255 - DNA, 15 bp, Homo sapiens
tgctggctcccttat

SEQ ID NO: 2256 - DNA, 15 bp, Homo sapiens
gctggctcccttatc

SEQ ID NO: 2257 - DNA, 15 bp, Homo sapiens
ctggctcccttatca

SEQ ID NO: 2258 - DNA, 15 bp, Homo sapiens
tggctcccttatcat

SEQ ID NO: 2259 - DNA, 15 bp, Homo sapiens
ggctcccttatcatg

SEQ ID NO: 2260 - DNA, 15 bp, Homo sapiens
gctcccttatcatgt

SEQ ID NO: 2261 - DNA, 15 bp, Homo sapiens
ctcccttatcatgtc

SEQ ID NO: 2262 - DNA, 15 bp, Homo sapiens
tcccttatcatgtcc

SEQ ID NO: 2263 - DNA, 15 bp, Homo sapiens
cccttatcatgtccc

SEQ ID NO: 2264 - DNA, 15 bp, Homo sapiens
ccttatcatgtccct

SEQ ID NO: 2265 - DNA, 15 bp, Homo sapiens
cttatcatgtccctt

SEQ ID NO: 2266 - DNA, 15 bp, Homo sapiens
ttatcatgtccctta

SEQ ID NO: 2267 - DNA, 15 bp, Homo sapiens
tatcatgtcccttat

SEQ ID NO: 2268 - DNA, 15 bp, Homo sapiens
atcatgtcccttatg

SEQ ID NO: 2269 - DNA, 15 bp, Homo sapiens
tcatgtcccttatgg

SEQ ID NO: 2270 - DNA, 15 bp, Homo sapiens
catgtcccttatggt

SEQ ID NO: 2271 - DNA, 15 bp, Homo sapiens
atgtcccttatggtg

SEQ ID NO: 2272 - DNA, 15 bp, Homo sapiens
tgtcccttatggtgc

SEQ ID NO: 2273 - DNA, 15 bp, Homo sapiens
gtcccttatggtgct

SEQ ID NO: 2274 - DNA, 15 bp, Homo sapiens
tcccttatggtgctt

SEQ ID NO: 2275 - DNA, 15 bp, Homo sapiens
cccttatggtgcttc

SEQ ID NO: 2276 - DNA, 15 bp, Homo sapiens
ccttatggtgcttct

SEQ ID NO: 2277 - DNA, 15 bp, Homo sapiens
cttatggtgcttctg

SEQ ID NO: 2278 - DNA, 15 bp, Homo sapiens
ttatggtgcttctgg

SEQ ID NO: 2279 - DNA, 15 bp, Homo sapiens
tatggtgcttctggc

SEQ ID NO: 2280 - DNA, 15 bp, Homo sapiens
atggtgcttctggct

SEQ ID NO: 2281 - DNA, 15 bp, Homo sapiens
tggtgcttctggctc

SEQ ID NO: 2282 - DNA, 15 bp, Homo sapiens
ggtgcttctggctct

SEQ ID NO: 2283 - DNA, 15 bp, Homo sapiens
gtgcttctggctctg

SEQ ID NO: 2284 - DNA, 15 bp, Homo sapiens
tgcttctggctctgc

SEQ ID NO: 2285 - DNA, 15 bp, Homo sapiens
gcttctggctctgca

SEQ ID NO: 2286 - DNA, 15 bp, Homo sapiens
cttctggctctgcag

SEQ ID NO: 2287 - DNA, 15 bp, Homo sapiens
ttctggctctgcagt

SEQ ID NO: 2288 - DNA, 15 bp, Homo sapiens
tctggctctgcagtt

SEQ ID NO: 2289 - DNA, 15 bp, Homo sapiens
ctggctctgcagtta

SEQ ID NO: 2290 - DNA, 15 bp, Homo sapiens
tggctctgcagttat

SEQ ID NO: 2291 - DNA, 15 bp, Homo sapiens
ggctctgcagttatt

SEQ ID NO: 2292 - DNA, 15 bp, Homo sapiens
gctctgcagttatta

SEQ ID NO: 2293 - DNA, 15 bp, Homo sapiens
ctctgcagttattag

SEQ ID NO: 2294 - DNA, 15 bp, Homo sapiens
tctgcagttattagc

SEQ ID NO: 2295 - DNA, 15 bp, Homo sapiens
ctgcagttattagca

SEQ ID NO: 2296 - DNA, 15 bp, Homo sapiens
tgcagttattagcat

SEQ ID NO: 2297 - DNA, 15 bp, Homo sapiens
gcagttattagcata

SEQ ID NO: 2298 - DNA, 15 bp, Homo sapiens
cagttattagcatag

SEQ ID NO: 2299 - DNA, 15 bp, Homo sapiens
agttattagcatagt

SEQ ID NO: 2300 - DNA, 15 bp, Homo sapiens
gttattagcatagtg

SEQ ID NO: 2301 - DNA, 15 bp, Homo sapiens
ttattagcatagtgt

SEQ ID NO: 2302 - DNA, 15 bp, Homo sapiens
tattagcatagtgtt

SEQ ID NO: 2303 - DNA, 15 bp, Homo sapiens
attagcatagtgtta

SEQ ID NO: 2304 - DNA, 15 bp, Homo sapiens
ttagcatagtgttac

SEQ ID NO: 2305 - DNA, 15 bp, Homo sapiens
tagcatagtgttacc

SEQ ID NO: 2306 - DNA, 15 bp, Homo sapiens
agcatagtgttacca

SEQ ID NO: 2307 - DNA, 15 bp, Homo sapiens
gcatagtgttaccat

SEQ ID NO: 2308 - DNA, 15 bp, Homo sapiens
catagtgttaccatc

SEQ ID NO: 2309 - DNA, 15 bp, Homo sapiens
atagtgttaccatca

SEQ ID NO: 2310 - DNA, 15 bp, Homo sapiens
tagtgttaccatcaa

SEQ ID NO: 2311 - DNA, 15 bp, Homo sapiens
agtgttaccatcaac

SEQ ID NO: 2312 - DNA, 15 bp, Homo sapiens
gtgttaccatcaacc

SEQ ID NO: 2313 - DNA, 15 bp, Homo sapiens
tgttaccatcaacca

SEQ ID NO: 2314 - DNA, 15 bp, Homo sapiens
gttaccatcaaccac

SEQ ID NO: 2315 - DNA, 15 bp, Homo sapiens
ttaccatcaaccacc

SEQ ID NO: 2316 - DNA, 15 bp, Homo sapiens
taccatcaaccacct

SEQ ID NO: 2317 - DNA, 15 bp, Homo sapiens
accatcaaccacctt

SEQ ID NO: 2318 - DNA, 15 bp, Homo sapiens
ccatcaaccacctta

SEQ ID NO: 2319 - DNA, 15 bp, Homo sapiens
catcaaccaccttaa

SEQ ID NO: 2320 - DNA, 15 bp, Homo sapiens
atcaaccaccttaac

SEQ ID NO: 2321 - DNA, 15 bp, Homo sapiens
tcaaccaccttaact

SEQ ID NO: 2322 - DNA, 15 bp, Homo sapiens
caaccaccttaactt

SEQ ID NO: 2323 - DNA, 15 bp, Homo sapiens
aaccaccttaacttc

SEQ ID NO: 2324 - DNA, 15 bp, Homo sapiens
accaccttaacttca

SEQ ID NO: 2325 - DNA, 15 bp, Homo sapiens
ccaccttaacttcat

SEQ ID NO: 2326 - DNA, 15 bp, Homo sapiens
caccttaacttcatt

SEQ ID NO: 2327 - DNA, 15 bp, Homo sapiens
accttaacttcattt

SEQ ID NO: 2328 - DNA, 15 bp, Homo sapiens
ccttaacttcatttt

SEQ ID NO: 2329 - DNA, 15 bp, Homo sapiens
cttaacttcattttt

SEQ ID NO: 2330 - DNA, 15 bp, Homo sapiens
ttaacttcatttttc

SEQ ID NO: 2331 - DNA, 15 bp, Homo sapiens
taacttcatttttct

SEQ ID NO: 2332 - DNA, 15 bp, Homo sapiens
aacttcatttttctt

SEQ ID NO: 2333 - DNA, 15 bp, Homo sapiens
acttcatttttctta

SEQ ID NO: 2334 - DNA, 15 bp, Homo sapiens
cttcatttttcttat

SEQ ID NO: 2335 - DNA, 15 bp, Homo sapiens
ttcatttttcttatt

SEQ ID NO: 2336 - DNA, 15 bp, Homo sapiens
tcatttttcttattc

SEQ ID NO: 2337 - DNA, 15 bp, Homo sapiens
catttttcttattca

SEQ ID NO: 2338 - DNA, 15 bp, Homo sapiens
atttttcttattcaa

SEQ ID NO: 2339 - DNA, 15 bp, Homo sapiens
tttttcttattcaat

SEQ ID NO: 2340 - DNA, 15 bp, Homo sapiens
ttttcttattcaata

SEQ ID NO: 2341 - DNA, 15 bp, Homo sapiens
tttcttattcaatac

SEQ ID NO: 2342 - DNA, 15 bp, Homo sapiens
ttcttattcaatacc

SEQ ID NO: 2343 - DNA, 15 bp, Homo sapiens
tcttattcaatacct

SEQ ID NO: 2344 - DNA, 15 bp, Homo sapiens
cttattcaataccta

SEQ ID NO: 2345 - DNA, 15 bp, Homo sapiens
ttattcaatacctag

SEQ ID NO: 2346 - DNA, 15 bp, Homo sapiens
tattcaatacctagg

SEQ ID NO: 2347 - DNA, 15 bp, Homo sapiens
attcaatacctaggt

SEQ ID NO: 2348 - DNA, 15 bp, Homo sapiens
ttcaatacctaggta

SEQ ID NO: 2349 - DNA, 15 bp, Homo sapiens
tcaatacctaggtag

SEQ ID NO: 2350 - DNA, 15 bp, Homo sapiens
caatacctaggtagg

SEQ ID NO: 2351 - DNA, 15 bp, Homo sapiens
aatacctaggtaggt

SEQ ID NO: 2352 - DNA, 15 bp, Homo sapiens
atacctaggtaggta

SEQ ID NO: 2353 - DNA, 15 bp, Homo sapiens
tacctaggtaggtag

SEQ ID NO: 2354 - DNA, 15 bp, Homo sapiens
acctaggtaggtaga

SEQ ID NO: 2355 - DNA, 15 bp, Homo sapiens
cctaggtaggtagat

SEQ ID NO: 2356 - DNA, 15 bp, Homo sapiens
ctaggtaggtagatg

SEQ ID NO: 2357 - DNA, 15 bp, Homo sapiens
taggtaggtagatgc

SEQ ID NO: 2358 - DNA, 15 bp, Homo sapiens
aggtaggtagatgct

SEQ ID NO: 2359 - DNA, 15 bp, Homo sapiens
ggtaggtagatgcta

SEQ ID NO: 2360 - DNA, 15 bp, Homo sapiens
gtaggtagatgctag

SEQ ID NO: 2361 - DNA, 15 bp, Homo sapiens
taggtagatgctaga

SEQ ID NO: 2362 - DNA, 15 bp, Homo sapiens
aggtagatgctagat

SEQ ID NO: 2363 - DNA, 15 bp, Homo sapiens
ggtagatgctagatt

SEQ ID NO: 2364 - DNA, 15 bp, Homo sapiens
gtagatgctagattc

SEQ ID NO: 2365 - DNA, 15 bp, Homo sapiens
tagatgctagattct

SEQ ID NO: 2366 - DNA, 15 bp, Homo sapiens
agatgctagattctg

SEQ ID NO: 2367 - DNA, 15 bp, Homo sapiens
gatgctagattctgg

SEQ ID NO: 2368 - DNA, 15 bp, Homo sapiens
atgctagattctgga

SEQ ID NO: 2369 - DNA, 15 bp, Homo sapiens
tgctagattctggaa

SEQ ID NO: 2370 - DNA, 15 bp, Homo sapiens
gctagattctggaaa

SEQ ID NO: 2371 - DNA, 15 bp, Homo sapiens
ctagattctggaaat

SEQ ID NO: 2372 - DNA, 15 bp, Homo sapiens
tagattctggaaata

SEQ ID NO: 2373 - DNA, 15 bp, Homo sapiens
agattctggaaataa

SEQ ID NO: 2374 - DNA, 15 bp, Homo sapiens
gattctggaaataaa

SEQ ID NO: 2375 - DNA, 15 bp, Homo sapiens
attctggaaataaaa

SEQ ID NO: 2376 - DNA, 15 bp, Homo sapiens
ttctggaaataaaat

SEQ ID NO: 2377 - DNA, 15 bp, Homo sapiens
tctggaaataaaata

SEQ ID NO: 2378 - DNA, 15 bp, Homo sapiens
ctggaaataaaatat

SEQ ID NO: 2379 - DNA, 15 bp, Homo sapiens
tggaaataaaatatg

SEQ ID NO: 2380 - DNA, 15 bp, Homo sapiens
ggaaataaaatatga

SEQ ID NO: 2381 - DNA, 15 bp, Homo sapiens
gaaataaaatatgag

SEQ ID NO: 2382 - DNA, 15 bp, Homo sapiens
aaataaaatatgagt

SEQ ID NO: 2383 - DNA, 15 bp, Homo sapiens
aataaaatatgagtc

SEQ ID NO: 2384 - DNA, 15 bp, Homo sapiens
ataaaatatgagtct

SEQ ID NO: 2385 - DNA, 15 bp, Homo sapiens
taaaatatgagtctc

SEQ ID NO: 2386 - DNA, 15 bp, Homo sapiens
aaaatatgagtctca

SEQ ID NO: 2387 - DNA, 15 bp, Homo sapiens
aaatatgagtctcaa

SEQ ID NO: 2388 - DNA, 15 bp, Homo sapiens
aatatgagtctcaag

SEQ ID NO: 2389 - DNA, 15 bp, Homo sapiens
atatgagtctcaagt

SEQ ID NO: 2390 - DNA, 15 bp, Homo sapiens
tatgagtctcaagtg

SEQ ID NO: 2391 - DNA, 15 bp, Homo sapiens
atgagtctcaagtgg

SEQ ID NO: 2392 - DNA, 15 bp, Homo sapiens
tgagtctcaagtggt

SEQ ID NO: 2393 - DNA, 15 bp, Homo sapiens
gagtctcaagtggtc

SEQ ID NO: 2394 - DNA, 15 bp, Homo sapiens
agtctcaagtggtcc

SEQ ID NO: 2395 - DNA, 15 bp, Homo sapiens
gtctcaagtggtcct

SEQ ID NO: 2396 - DNA, 15 bp, Homo sapiens
tctcaagtggtcctt

SEQ ID NO: 2397 - DNA, 15 bp, Homo sapiens
ctcaagtggtccttg

SEQ ID NO: 2398 - DNA, 15 bp, Homo sapiens
tcaagtggtccttgt

SEQ ID NO: 2399 - DNA, 15 bp, Homo sapiens
caagtggtccttgtc

SEQ ID NO: 2400 - DNA, 15 bp, Homo sapiens
aagtggtccttgtcc

SEQ ID NO: 2401 - DNA, 15 bp, Homo sapiens
agtggtccttgtcct

SEQ ID NO: 2402 - DNA, 15 bp, Homo sapiens
gtggtccttgtcctc

SEQ ID NO: 2403 - DNA, 15 bp, Homo sapiens
tggtccttgtcctct

SEQ ID NO: 2404 - DNA, 15 bp, Homo sapiens
ggtccttgtcctctc

SEQ ID NO: 2405 - DNA, 15 bp, Homo sapiens
gtccttgtcctctct

SEQ ID NO: 2406 - DNA, 15 bp, Homo sapiens
tccttgtcctctctc

SEQ ID NO: 2407 - DNA, 15 bp, Homo sapiens
ccttgtcctctctcc

SEQ ID NO: 2408 - DNA, 15 bp, Homo sapiens
cttgtcctctctccc

SEQ ID NO: 2409 - DNA, 15 bp, Homo sapiens
ttgtcctctctccca

SEQ ID NO: 2410 - DNA, 15 bp, Homo sapiens
tgtcctctctcccag

SEQ ID NO: 2411 - DNA, 15 bp, Homo sapiens
gtcctctctcccagt

SEQ ID NO: 2412 - DNA, 15 bp, Homo sapiens
tcctctctcccagtc

SEQ ID NO: 2413 - DNA, 15 bp, Homo sapiens
cctctctcccagtca

SEQ ID NO: 2414 - DNA, 15 bp, Homo sapiens
ctctctcccagtcaa

SEQ ID NO: 2415 - DNA, 15 bp, Homo sapiens
tctctcccagtcaaa

SEQ ID NO: 2416 - DNA, 15 bp, Homo sapiens
ctctcccagtcaaat

SEQ ID NO: 2417 - DNA, 15 bp, Homo sapiens
tctcccagtcaaatt

SEQ ID NO: 2418 - DNA, 15 bp, Homo sapiens
ctcccagtcaaattc

SEQ ID NO: 2419 - DNA, 15 bp, Homo sapiens
tcccagtcaaattct

SEQ ID NO: 2420 - DNA, 15 bp, Homo sapiens
cccagtcaaattctg

SEQ ID NO: 2421 - DNA, 15 bp, Homo sapiens
ccagtcaaattctga

SEQ ID NO: 2422 - DNA, 15 bp, Homo sapiens
cagtcaaattctgaa

SEQ ID NO: 2423 - DNA, 15 bp, Homo sapiens
agtcaaattctgaat

SEQ ID NO: 2424 - DNA, 15 bp, Homo sapiens
gtcaaattctgaatc

SEQ ID NO: 2425 - DNA, 15 bp, Homo sapiens
tcaaattctgaatct

SEQ ID NO: 2426 - DNA, 15 bp, Homo sapiens
caaattctgaatcta

SEQ ID NO: 2427 - DNA, 15 bp, Homo sapiens
aaattctgaatctag

SEQ ID NO: 2428 - DNA, 15 bp, Homo sapiens
aattctgaatctagt

SEQ ID NO: 2429 - DNA, 15 bp, Homo sapiens
attctgaatctagtt

SEQ ID NO: 2430 - DNA, 15 bp, Homo sapiens
ttctgaatctagttg

SEQ ID NO: 2431 - DNA, 15 bp, Homo sapiens
tctgaatctagttgg

SEQ ID NO: 2432 - DNA, 15 bp, Homo sapiens
ctgaatctagttggc

SEQ ID NO: 2433 - DNA, 15 bp, Homo sapiens
tgaatctagttggca

SEQ ID NO: 2434 - DNA, 15 bp, Homo sapiens
gaatctagttggcaa

SEQ ID NO: 2435 - DNA, 15 bp, Homo sapiens
aatctagttggcaag

SEQ ID NO: 2436 - DNA, 15 bp, Homo sapiens
atctagttggcaaga

SEQ ID NO: 2437 - DNA, 15 bp, Homo sapiens
tctagttggcaagat

SEQ ID NO: 2438 - DNA, 15 bp, Homo sapiens
ctagttggcaagatt

SEQ ID NO: 2439 - DNA, 15 bp, Homo sapiens
tagttggcaagattc

SEQ ID NO: 2440 - DNA, 15 bp, Homo sapiens
agttggcaagattct

SEQ ID NO: 2441 - DNA, 15 bp, Homo sapiens
gttggcaagattctg

SEQ ID NO: 2442 - DNA, 15 bp, Homo sapiens
ttggcaagattctga

SEQ ID NO: 2443 - DNA, 15 bp, Homo sapiens
tggcaagattctgaa

SEQ ID NO: 2444 - DNA, 15 bp, Homo sapiens
ggcaagattctgaaa

SEQ ID NO: 2445 - DNA, 15 bp, Homo sapiens
gcaagattctgaaat

SEQ ID NO: 2446 - DNA, 15 bp, Homo sapiens
caagattctgaaatc

SEQ ID NO: 2447 - DNA, 15 bp, Homo sapiens
aagattctgaaatca

SEQ ID NO: 2448 - DNA, 15 bp, Homo sapiens
agattctgaaatcaa

SEQ ID NO: 2449 - DNA, 15 bp, Homo sapiens
gattctgaaatcaag

SEQ ID NO: 2450 - DNA, 15 bp, Homo sapiens
attctgaaatcaagg

SEQ ID NO: 2451 - DNA, 15 bp, Homo sapiens
ttctgaaatcaaggc

SEQ ID NO: 2452 - DNA, 15 bp, Homo sapiens
tctgaaatcaaggca

SEQ ID NO: 2453 - DNA, 15 bp, Homo sapiens
ctgaaatcaaggcat

SEQ ID NO: 2454 - DNA, 15 bp, Homo sapiens
tgaaatcaaggcata

SEQ ID NO: 2455 - DNA, 15 bp, Homo sapiens
gaaatcaaggcatat

SEQ ID NO: 2456 - DNA, 15 bp, Homo sapiens
aaatcaaggcatata

SEQ ID NO: 2457 - DNA, 15 bp, Homo sapiens
aatcaaggcatataa

SEQ ID NO: 2458 - DNA, 15 bp, Homo sapiens
atcaaggcatataat

SEQ ID NO: 2459 - DNA, 15 bp, Homo sapiens
tcaaggcatataatc

SEQ ID NO: 2460 - DNA, 15 bp, Homo sapiens
caaggcatataatca

SEQ ID NO: 2461 - DNA, 15 bp, Homo sapiens
aaggcatataatcag

SEQ ID NO: 2462 - DNA, 15 bp, Homo sapiens
aggcatataatcagt

SEQ ID NO: 2463 - DNA, 15 bp, Homo sapiens
ggcatataatcagta

SEQ ID NO: 2464 - DNA, 15 bp, Homo sapiens
gcatataatcagtaa

SEQ ID NO: 2465 - DNA, 15 bp, Homo sapiens
catataatcagtaat

SEQ ID NO: 2466 - DNA, 15 bp, Homo sapiens
atataatcagtaata

SEQ ID NO: 2467 - DNA, 15 bp, Homo sapiens
tataatcagtaataa

SEQ ID NO: 2468 - DNA, 15 bp, Homo sapiens
ataatcagtaataag

SEQ ID NO: 2469 - DNA, 15 bp, Homo sapiens
taatcagtaataagt

SEQ ID NO: 2470 - DNA, 15 bp, Homo sapiens
aatcagtaataagtg

SEQ ID NO: 2471 - DNA, 15 bp, Homo sapiens
atcagtaataagtga

SEQ ID NO: 2472 - DNA, 15 bp, Homo sapiens
tcagtaataagtgat

SEQ ID NO: 2473 - DNA, 15 bp, Homo sapiens
cagtaataagtgatg

SEQ ID NO: 2474 - DNA, 15 bp, Homo sapiens
agtaataagtgatga

SEQ ID NO: 2475 - DNA, 15 bp, Homo sapiens
gtaataagtgatgat

SEQ ID NO: 2476 - DNA, 15 bp, Homo sapiens
taataagtgatgata

SEQ ID NO: 2477 - DNA, 15 bp, Homo sapiens
aataagtgatgatag

SEQ ID NO: 2478 - DNA, 15 bp, Homo sapiens
ataagtgatgataga

SEQ ID NO: 2479 - DNA, 15 bp, Homo sapiens
taagtgatgatagaa

SEQ ID NO: 2480 - DNA, 15 bp, Homo sapiens
aagtgatgatagaag

SEQ ID NO: 2481 - DNA, 15 bp, Homo sapiens
agtgatgatagaagg

SEQ ID NO: 2482 - DNA, 15 bp, Homo sapiens
gtgatgatagaaggg

SEQ ID NO: 2483 - DNA, 15 bp, Homo sapiens
tgatgatagaagggt

SEQ ID NO: 2484 - DNA, 15 bp, Homo sapiens
gatgatagaagggta

SEQ ID NO: 2485 - DNA, 15 bp, Homo sapiens
atgatagaagggtat

SEQ ID NO: 2486 - DNA, 15 bp, Homo sapiens
tgatagaagggtata

SEQ ID NO: 2487 - DNA, 15 bp, Homo sapiens
gatagaagggtatat

SEQ ID NO: 2488 - DNA, 15 bp, Homo sapiens
atagaagggtatata

SEQ ID NO: 2489 - DNA, 15 bp, Homo sapiens
tagaagggtatatag

SEQ ID NO: 2490 - DNA, 15 bp, Homo sapiens
agaagggtatataga

SEQ ID NO: 2491 - DNA, 15 bp, Homo sapiens
gaagggtatatagaa

SEQ ID NO: 2492 - DNA, 15 bp, Homo sapiens
aagggtatatagaag

SEQ ID NO: 2493 - DNA, 15 bp, Homo sapiens
agggtatatagaaga

SEQ ID NO: 2494 - DNA, 15 bp, Homo sapiens
gggtatatagaagaa

SEQ ID NO: 2495 - DNA, 15 bp, Homo sapiens
ggtatatagaagaat

SEQ ID NO: 2496 - DNA, 15 bp, Homo sapiens
gtatatagaagaatt

SEQ ID NO: 2497 - DNA, 15 bp, Homo sapiens
tatatagaagaattt

SEQ ID NO: 2498 - DNA, 15 bp, Homo sapiens
atatagaagaatttt

SEQ ID NO: 2499 - DNA, 15 bp, Homo sapiens
tatagaagaatttta

SEQ ID NO: 2500 - DNA, 15 bp, Homo sapiens
atagaagaattttat

SEQ ID NO: 2501 - DNA, 15 bp, Homo sapiens
tagaagaattttatt

SEQ ID NO: 2502 - DNA, 15 bp, Homo sapiens
agaagaattttatta

SEQ ID NO: 2503 - DNA, 15 bp, Homo sapiens
gaagaattttattat

SEQ ID NO: 2504 - DNA, 15 bp, Homo sapiens
aagaattttattata

SEQ ID NO: 2505 - DNA, 15 bp, Homo sapiens
agaattttattatat

SEQ ID NO: 2506 - DNA, 15 bp, Homo sapiens
gaattttattatatg

SEQ ID NO: 2507 - DNA, 15 bp, Homo sapiens
aattttattatatga

SEQ ID NO: 2508 - DNA, 15 bp, Homo sapiens
attttattatatgag

SEQ ID NO: 2509 - DNA, 15 bp, Homo sapiens
ttttattatatgaga

SEQ ID NO: 2510 - DNA, 15 bp, Homo sapiens
tttattatatgagag

SEQ ID NO: 2511 - DNA, 15 bp, Homo sapiens
ttattatatgagagg

SEQ ID NO: 2512 - DNA, 15 bp, Homo sapiens
tattatatgagaggg

SEQ ID NO: 2513 - DNA, 15 bp, Homo sapiens
attatatgagagggt

SEQ ID NO: 2514 - DNA, 15 bp, Homo sapiens
ttatatgagagggtg

SEQ ID NO: 2515 - DNA, 15 bp, Homo sapiens
tatatgagagggtga

SEQ ID NO: 2516 - DNA, 15 bp, Homo sapiens
atatgagagggtgaa

SEQ ID NO: 2517 - DNA, 15 bp, Homo sapiens
tatgagagggtgaaa

SEQ ID NO: 2518 - DNA, 15 bp, Homo sapiens
atgagagggtgaaac

SEQ ID NO: 2519 - DNA, 15 bp, Homo sapiens
tgagagggtgaaacc

SEQ ID NO: 2520 - DNA, 15 bp, Homo sapiens
gagagggtgaaaccc

SEQ ID NO: 2521 - DNA, 15 bp, Homo sapiens
agagggtgaaaccct

SEQ ID NO: 2522 - DNA, 15 bp, Homo sapiens
gagggtgaaaccctc

SEQ ID NO: 2523 - DNA, 15 bp, Homo sapiens
agggtgaaaccctca

SEQ ID NO: 2524 - DNA, 15 bp, Homo sapiens
gggtgaaaccctcaa

SEQ ID NO: 2525 - DNA, 15 bp, Homo sapiens
ggtgaaaccctcaaa

SEQ ID NO: 2526 - DNA, 15 bp, Homo sapiens
gtgaaaccctcaaaa

SEQ ID NO: 2527 - DNA, 15 bp, Homo sapiens
tgaaaccctcaaaat

SEQ ID NO: 2528 - DNA, 15 bp, Homo sapiens
gaaaccctcaaaatg

SEQ ID NO: 2529 - DNA, 15 bp, Homo sapiens
aaaccctcaaaatga

SEQ ID NO: 2530 - DNA, 15 bp, Homo sapiens
aaccctcaaaatgaa

SEQ ID NO: 2531 - DNA, 15 bp, Homo sapiens
accctcaaaatgaaa

SEQ ID NO: 2532 - DNA, 15 bp, Homo sapiens
ccctcaaaatgaaat

SEQ ID NO: 2533 - DNA, 15 bp, Homo sapiens
cctcaaaatgaaatg

SEQ ID NO: 2534 - DNA, 15 bp, Homo sapiens
ctcaaaatgaaatga

SEQ ID NO: 2535 - DNA, 15 bp, Homo sapiens
tcaaaatgaaatgaa

SEQ ID NO: 2536 - DNA, 15 bp, Homo sapiens
caaaatgaaatgaaa

SEQ ID NO: 2537 - DNA, 15 bp, Homo sapiens
aaaatgaaatgaaat

SEQ ID NO: 2538 - DNA, 15 bp, Homo sapiens
aaatgaaatgaaatc

SEQ ID NO: 2539 - DNA, 15 bp, Homo sapiens
aatgaaatgaaatca

SEQ ID NO: 2540 - DNA, 15 bp, Homo sapiens
atgaaatgaaatcag

SEQ ID NO: 2541 - DNA, 15 bp, Homo sapiens
tgaaatgaaatcaga

SEQ ID NO: 2542 - DNA, 15 bp, Homo sapiens
gaaatgaaatcagac

SEQ ID NO: 2543 - DNA, 15 bp, Homo sapiens
aaatgaaatcagacc

SEQ ID NO: 2544 - DNA, 15 bp, Homo sapiens
aatgaaatcagaccc

SEQ ID NO: 2545 - DNA, 15 bp, Homo sapiens
atgaaatcagaccct

SEQ ID NO: 2546 - DNA, 15 bp, Homo sapiens
tgaaatcagaccctt

SEQ ID NO: 2547 - DNA, 15 bp, Homo sapiens
gaaatcagacccttg

SEQ ID NO: 2548 - DNA, 15 bp, Homo sapiens
aaatcagacccttgt

SEQ ID NO: 2549 - DNA, 15 bp, Homo sapiens
aatcagacccttgtc

SEQ ID NO: 2550 - DNA, 15 bp, Homo sapiens
atcagacccttgtct

SEQ ID NO: 2551 - DNA, 15 bp, Homo sapiens
tcagacccttgtctt

SEQ ID NO: 2552 - DNA, 15 bp, Homo sapiens
cagacccttgtctta

SEQ ID NO: 2553 - DNA, 15 bp, Homo sapiens
agacccttgtcttac

SEQ ID NO: 2554 - DNA, 15 bp, Homo sapiens
gacccttgtcttaca

SEQ ID NO: 2555 - DNA, 15 bp, Homo sapiens
acccttgtcttacac

SEQ ID NO: 2556 - DNA, 15 bp, Homo sapiens
cccttgtcttacacc

SEQ ID NO: 2557 - DNA, 15 bp, Homo sapiens
ccttgtcttacacca

SEQ ID NO: 2558 - DNA, 15 bp, Homo sapiens
cttgtcttacaccat

SEQ ID NO: 2559 - DNA, 15 bp, Homo sapiens
ttgtcttacaccata

SEQ ID NO: 2560 - DNA, 15 bp, Homo sapiens
tgtcttacaccataa

SEQ ID NO: 2561 - DNA, 15 bp, Homo sapiens
gtcttacaccataaa

SEQ ID NO: 2562 - DNA, 15 bp, Homo sapiens
tcttacaccataaac

SEQ ID NO: 2563 - DNA, 15 bp, Homo sapiens
cttacaccataaaca

SEQ ID NO: 2564 - DNA, 15 bp, Homo sapiens
ttacaccataaacaa

SEQ ID NO: 2565 - DNA, 15 bp, Homo sapiens
tacaccataaacaaa

SEQ ID NO: 2566 - DNA, 15 bp, Homo sapiens
acaccataaacaaaa

SEQ ID NO: 2567 - DNA, 15 bp, Homo sapiens
caccataaacaaaaa

SEQ ID NO: 2568 - DNA, 15 bp, Homo sapiens
accataaacaaaaat

SEQ ID NO: 2569 - DNA, 15 bp, Homo sapiens
ccataaacaaaaata

SEQ ID NO: 2570 - DNA, 15 bp, Homo sapiens
cataaacaaaaataa

SEQ ID NO: 2571 - DNA, 15 bp, Homo sapiens
ataaacaaaaataaa

SEQ ID NO: 2572 - DNA, 15 bp, Homo sapiens
taaacaaaaataaat

SEQ ID NO: 2573 - DNA, 15 bp, Homo sapiens
aaacaaaaataaatt

SEQ ID NO: 2574 - DNA, 15 bp, Homo sapiens
aacaaaaataaattt

SEQ ID NO: 2575 - DNA, 15 bp, Homo sapiens
acaaaaataaatttg

SEQ ID NO: 2576 - DNA, 15 bp, Homo sapiens
caaaaataaatttga

SEQ ID NO: 2577 - DNA, 15 bp, Homo sapiens
aaaaataaatttgaa

SEQ ID NO: 2578 - DNA, 15 bp, Homo sapiens
aaaataaatttgaat

SEQ ID NO: 2579 - DNA, 15 bp, Homo sapiens
aaataaatttgaatg

SEQ ID NO: 2580 - DNA, 15 bp, Homo sapiens
aataaatttgaatgg

SEQ ID NO: 2581 - DNA, 15 bp, Homo sapiens
ataaatttgaatggg

SEQ ID NO: 2582 - DNA, 15 bp, Homo sapiens
taaatttgaatgggt

SEQ ID NO: 2583 - DNA, 15 bp, Homo sapiens
aaatttgaatgggtt

SEQ ID NO: 2584 - DNA, 15 bp, Homo sapiens
aatttgaatgggtta

SEQ ID NO: 2585 - DNA, 15 bp, Homo sapiens
atttgaatgggttaa

SEQ ID NO: 2586 - DNA, 15 bp, Homo sapiens
tttgaatgggttaaa

SEQ ID NO: 2587 - DNA, 15 bp, Homo sapiens
ttgaatgggttaaag

SEQ ID NO: 2588 - DNA, 15 bp, Homo sapiens
tgaatgggttaaaga

SEQ ID NO: 2589 - DNA, 15 bp, Homo sapiens
gaatgggttaaagaa

SEQ ID NO: 2590 - DNA, 15 bp, Homo sapiens
aatgggttaaagaat

SEQ ID NO: 2591 - DNA, 15 bp, Homo sapiens
atgggttaaagaatt

SEQ ID NO: 2592 - DNA, 15 bp, Homo sapiens
tgggttaaagaatta

SEQ ID NO: 2593 - DNA, 15 bp, Homo sapiens
gggttaaagaattaa

SEQ ID NO: 2594 - DNA, 15 bp, Homo sapiens
ggttaaagaattaaa

SEQ ID NO: 2595 - DNA, 15 bp, Homo sapiens
gttaaagaattaaac

SEQ ID NO: 2596 - DNA, 15 bp, Homo sapiens
ttaaagaattaaact

SEQ ID NO: 2597 - DNA, 15 bp, Homo sapiens
taaagaattaaacta

SEQ ID NO: 2598 - DNA, 15 bp, Homo sapiens
aaagaattaaactaa

SEQ ID NO: 2599 - DNA, 15 bp, Homo sapiens
aagaattaaactaag

SEQ ID NO: 2600 - DNA, 15 bp, Homo sapiens
agaattaaactaaga

SEQ ID NO: 2601 - DNA, 15 bp, Homo sapiens
gaattaaactaagac

SEQ ID NO: 2602 - DNA, 15 bp, Homo sapiens
aattaaactaagacc

SEQ ID NO: 2603 - DNA, 15 bp, Homo sapiens
attaaactaagacct

SEQ ID NO: 2604 - DNA, 15 bp, Homo sapiens
ttaaactaagaccta

SEQ ID NO: 2605 - DNA, 15 bp, Homo sapiens
taaactaagacctaa

SEQ ID NO: 2606 - DNA, 15 bp, Homo sapiens
aaactaagacctaaa

SEQ ID NO: 2607 - DNA, 15 bp, Homo sapiens
aactaagacctaaaa

SEQ ID NO: 2608 - DNA, 15 bp, Homo sapiens
actaagacctaaaac

SEQ ID NO: 2609 - DNA, 15 bp, Homo sapiens
ctaagacctaaaacc

SEQ ID NO: 2610 - DNA, 15 bp, Homo sapiens
taagacctaaaacca

SEQ ID NO: 2611 - DNA, 15 bp, Homo sapiens
aagacctaaaaccat

SEQ ID NO: 2612 - DNA, 15 bp, Homo sapiens
agacctaaaaccata

SEQ ID NO: 2613 - DNA, 15 bp, Homo sapiens
gacctaaaaccataa

SEQ ID NO: 2614 - DNA, 15 bp, Homo sapiens
acctaaaaccataaa

SEQ ID NO: 2615 - DNA, 15 bp, Homo sapiens
cctaaaaccataaaa

SEQ ID NO: 2616 - DNA, 15 bp, Homo sapiens
ctaaaaccataaaaa

SEQ ID NO: 2617 - DNA, 15 bp, Homo sapiens
taaaaccataaaaat

SEQ ID NO: 2618 - DNA, 15 bp, Homo sapiens
aaaaccataaaaatt

SEQ ID NO: 2619 - DNA, 15 bp, Homo sapiens
aaaccataaaaattt

SEQ ID NO: 2620 - DNA, 15 bp, Homo sapiens
aaccataaaaatttt

SEQ ID NO: 2621 - DNA, 15 bp, Homo sapiens
accataaaaattttt

SEQ ID NO: 2622 - DNA, 15 bp, Homo sapiens
ccataaaaattttta

SEQ ID NO: 2623 - DNA, 15 bp, Homo sapiens
cataaaaatttttaa

SEQ ID NO: 2624 - DNA, 15 bp, Homo sapiens
ataaaaatttttaaa

SEQ ID NO: 2625 - DNA, 15 bp, Homo sapiens
taaaaatttttaaag

SEQ ID NO: 2626 - DNA, 15 bp, Homo sapiens
aaaaatttttaaaga

SEQ ID NO: 2627 - DNA, 15 bp, Homo sapiens
aaaatttttaaagaa

SEQ ID NO: 2628 - DNA, 15 bp, Homo sapiens
aaatttttaaagaaa

SEQ ID NO: 2629 - DNA, 15 bp, Homo sapiens
aatttttaaagaaat

SEQ ID NO: 2630 - DNA, 15 bp, Homo sapiens
atttttaaagaaatc

SEQ ID NO: 2631 - DNA, 15 bp, Homo sapiens
tttttaaagaaatca

SEQ ID NO: 2632 - DNA, 15 bp, Homo sapiens
ttttaaagaaatcaa

SEQ ID NO: 2633 - DNA, 15 bp, Homo sapiens
tttaaagaaatcaaa

SEQ ID NO: 2634 - DNA, 15 bp, Homo sapiens
ttaaagaaatcaaaa

SEQ ID NO: 2635 - DNA, 15 bp, Homo sapiens
taaagaaatcaaaag

SEQ ID NO: 2636 - DNA, 15 bp, Homo sapiens
aaagaaatcaaaaga

SEQ ID NO: 2637 - DNA, 15 bp, Homo sapiens
aagaaatcaaaagaa

SEQ ID NO: 2638 - DNA, 15 bp, Homo sapiens
agaaatcaaaagaag

SEQ ID NO: 2639 - DNA, 15 bp, Homo sapiens
gaaatcaaaagaaga

SEQ ID NO: 2640 - DNA, 15 bp, Homo sapiens
aaatcaaaagaagaa

SEQ ID NO: 2641 - DNA, 15 bp, Homo sapiens
aatcaaaagaagaaa

SEQ ID NO: 2642 - DNA, 15 bp, Homo sapiens
atcaaaagaagaaaa

SEQ ID NO: 2643 - DNA, 15 bp, Homo sapiens
tcaaaagaagaaaat

SEQ ID NO: 2644 - DNA, 15 bp, Homo sapiens
caaaagaagaaaatt

SEQ ID NO: 2645 - DNA, 15 bp, Homo sapiens
aaaagaagaaaattc

SEQ ID NO: 2646 - DNA, 15 bp, Homo sapiens
aaagaagaaaattct

SEQ ID NO: 2647 - DNA, 15 bp, Homo sapiens
aagaagaaaattcta

SEQ ID NO: 2648 - DNA, 15 bp, Homo sapiens
agaagaaaattctaa

SEQ ID NO: 2649 - DNA, 15 bp, Homo sapiens
gaagaaaattctaat

SEQ ID NO: 2650 - DNA, 15 bp, Homo sapiens
aagaaaattctaata

SEQ ID NO: 2651 - DNA, 15 bp, Homo sapiens
agaaaattctaatat

SEQ ID NO: 2652 - DNA, 15 bp, Homo sapiens
gaaaattctaatatt

SEQ ID NO: 2653 - DNA, 15 bp, Homo sapiens
aaaattctaatattc

SEQ ID NO: 2654 - DNA, 15 bp, Homo sapiens
aaattctaatattca

SEQ ID NO: 2655 - DNA, 15 bp, Homo sapiens
aattctaatattcac

SEQ ID NO: 2656 - DNA, 15 bp, Homo sapiens
attctaatattcacg

SEQ ID NO: 2657 - DNA, 15 bp, Homo sapiens
ttctaatattcacgt

SEQ ID NO: 2658 - DNA, 15 bp, Homo sapiens
tctaatattcacgtt

SEQ ID NO: 2659 - DNA, 15 bp, Homo sapiens
ctaatattcacgttg

SEQ ID NO: 2660 - DNA, 15 bp, Homo sapiens
taatattcacgttgc

SEQ ID NO: 2661 - DNA, 15 bp, Homo sapiens
aatattcacgttgca

SEQ ID NO: 2662 - DNA, 15 bp, Homo sapiens
atattcacgttgcag

SEQ ID NO: 2663 - DNA, 15 bp, Homo sapiens
tattcacgttgcagc

SEQ ID NO: 2664 - DNA, 15 bp, Homo sapiens
attcacgttgcagcc

SEQ ID NO: 2665 - DNA, 15 bp, Homo sapiens
ttcacgttgcagccg

SEQ ID NO: 2666 - DNA, 15 bp, Homo sapiens
tcacgttgcagccgt

SEQ ID NO: 2667 - DNA, 15 bp, Homo sapiens
cacgttgcagccgtt

SEQ ID NO: 2668 - DNA, 15 bp, Homo sapiens
acgttgcagccgttt

SEQ ID NO: 2669 - DNA, 15 bp, Homo sapiens
cgttgcagccgtttt

SEQ ID NO: 2670 - DNA, 15 bp, Homo sapiens
gttgcagccgttttt

SEQ ID NO: 2671 - DNA, 15 bp, Homo sapiens
ttgcagccgtttttt

SEQ ID NO: 2672 - DNA, 15 bp, Homo sapiens
tgcagccgttttttg

SEQ ID NO: 2673 - DNA, 15 bp, Homo sapiens
gcagccgttttttga

SEQ ID NO: 2674 - DNA, 15 bp, Homo sapiens
cagccgttttttgaa

SEQ ID NO: 2675 - DNA, 15 bp, Homo sapiens
agccgttttttgaat

SEQ ID NO: 2676 - DNA, 15 bp, Homo sapiens
gccgttttttgaatt

SEQ ID NO: 2677 - DNA, 15 bp, Homo sapiens
ccgttttttgaattt

SEQ ID NO: 2678 - DNA, 15 bp, Homo sapiens
cgttttttgaatttg

SEQ ID NO: 2679 - DNA, 15 bp, Homo sapiens
gttttttgaatttga

SEQ ID NO: 2680 - DNA, 15 bp, Homo sapiens
ttttttgaatttgat

SEQ ID NO: 2681 - DNA, 15 bp, Homo sapiens
tttttgaatttgata

SEQ ID NO: 2682 - DNA, 15 bp, Homo sapiens
ttttgaatttgatat

SEQ ID NO: 2683 - DNA, 15 bp, Homo sapiens
tttgaatttgatatg

SEQ ID NO: 2684 - DNA, 15 bp, Homo sapiens
ttgaatttgatatga

SEQ ID NO: 2685 - DNA, 15 bp, Homo sapiens
tgaatttgatatgag

SEQ ID NO: 2686 - DNA, 15 bp, Homo sapiens
gaatttgatatgaga

SEQ ID NO: 2687 - DNA, 15 bp, Homo sapiens
aatttgatatgagaa

SEQ ID NO: 2688 - DNA, 15 bp, Homo sapiens
atttgatatgagaag

SEQ ID NO: 2689 - DNA, 15 bp, Homo sapiens
tttgatatgagaagc

SEQ ID NO: 2690 - DNA, 15 bp, Homo sapiens
ttgatatgagaagca

SEQ ID NO: 2691 - DNA, 15 bp, Homo sapiens
tgatatgagaagcaa

SEQ ID NO: 2692 - DNA, 15 bp, Homo sapiens
gatatgagaagcaaa

SEQ ID NO: 2693 - DNA, 15 bp, Homo sapiens
atatgagaagcaaag

SEQ ID NO: 2694 - DNA, 15 bp, Homo sapiens
tatgagaagcaaagg

SEQ ID NO: 2695 - DNA, 15 bp, Homo sapiens
atgagaagcaaaggc

SEQ ID NO: 2696 - DNA, 15 bp, Homo sapiens
tgagaagcaaaggca

SEQ ID NO: 2697 - DNA, 15 bp, Homo sapiens
gagaagcaaaggcaa

SEQ ID NO: 2698 - DNA, 15 bp, Homo sapiens
agaagcaaaggcaac

SEQ ID NO: 2699 - DNA, 15 bp, Homo sapiens
gaagcaaaggcaaca

SEQ ID NO: 2700 - DNA, 15 bp, Homo sapiens
aagcaaaggcaacaa

SEQ ID NO: 2701 - DNA, 15 bp, Homo sapiens
agcaaaggcaacaaa

SEQ ID NO: 2702 - DNA, 15 bp, Homo sapiens
gcaaaggcaacaaaa

SEQ ID NO: 2703 - DNA, 15 bp, Homo sapiens
caaaggcaacaaaag

SEQ ID NO: 2704 - DNA, 15 bp, Homo sapiens
aaaggcaacaaaagg

SEQ ID NO: 2705 - DNA, 15 bp, Homo sapiens
aaggcaacaaaagga

SEQ ID NO: 2706 - DNA, 15 bp, Homo sapiens
aggcaacaaaaggaa

SEQ ID NO: 2707 - DNA, 15 bp, Homo sapiens
ggcaacaaaaggaaa

SEQ ID NO: 2708 - DNA, 15 bp, Homo sapiens
gcaacaaaaggaaaa

SEQ ID NO: 2709 - DNA, 15 bp, Homo sapiens
caacaaaaggaaaaa

SEQ ID NO: 2710 - DNA, 15 bp, Homo sapiens
aacaaaaggaaaaat

SEQ ID NO: 2711 - DNA, 15 bp, Homo sapiens
acaaaaggaaaaata

SEQ ID NO: 2712 - DNA, 15 bp, Homo sapiens
caaaaggaaaaataa

SEQ ID NO: 2713 - DNA, 15 bp, Homo sapiens
aaaaggaaaaataaa

SEQ ID NO: 2714 - DNA, 15 bp, Homo sapiens
aaaggaaaaataaag

SEQ ID NO: 2715 - DNA, 15 bp, Homo sapiens
aaggaaaaataaaga

SEQ ID NO: 2716 - DNA, 15 bp, Homo sapiens
aggaaaaataaagaa

SEQ ID NO: 2717 - DNA, 15 bp, Homo sapiens
ggaaaaataaagaag

SEQ ID NO: 2718 - DNA, 15 bp, Homo sapiens
gaaaaataaagaagt

SEQ ID NO: 2719 - DNA, 15 bp, Homo sapiens
aaaaataaagaagtg

SEQ ID NO: 2720 - DNA, 15 bp, Homo sapiens
aaaataaagaagtga

SEQ ID NO: 2721 - DNA, 15 bp, Homo sapiens
aaataaagaagtgag

SEQ ID NO: 2722 - DNA, 15 bp, Homo sapiens
aataaagaagtgagg

SEQ ID NO: 2723 - DNA, 15 bp, Homo sapiens
ataaagaagtgaggc

SEQ ID NO: 2724 - DNA, 15 bp, Homo sapiens
taaagaagtgaggct

SEQ ID NO: 2725 - DNA, 15 bp, Homo sapiens
aaagaagtgaggcta

SEQ ID NO: 2726 - DNA, 15 bp, Homo sapiens
aagaagtgaggctac

SEQ ID NO: 2727 - DNA, 15 bp, Homo sapiens
agaagtgaggctaca

SEQ ID NO: 2728 - DNA, 15 bp, Homo sapiens
gaagtgaggctacat

SEQ ID NO: 2729 - DNA, 15 bp, Homo sapiens
aagtgaggctacatc

SEQ ID NO: 2730 - DNA, 15 bp, Homo sapiens
agtgaggctacatca

SEQ ID NO: 2731 - DNA, 15 bp, Homo sapiens
gtgaggctacatcaa

SEQ ID NO: 2732 - DNA, 15 bp, Homo sapiens
tgaggctacatcaaa

SEQ ID NO: 2733 - DNA, 15 bp, Homo sapiens
gaggctacatcaaac

SEQ ID NO: 2734 - DNA, 15 bp, Homo sapiens
aggctacatcaaact

SEQ ID NO: 2735 - DNA, 15 bp, Homo sapiens
ggctacatcaaacta

SEQ ID NO: 2736 - DNA, 15 bp, Homo sapiens
gctacatcaaactaa

SEQ ID NO: 2737 - DNA, 15 bp, Homo sapiens
ctacatcaaactaaa

SEQ ID NO: 2738 - DNA, 15 bp, Homo sapiens
tacatcaaactaaaa

SEQ ID NO: 2739 - DNA, 15 bp, Homo sapiens
acatcaaactaaaaa

SEQ ID NO: 2740 - DNA, 15 bp, Homo sapiens
catcaaactaaaaaa

SEQ ID NO: 2741 - DNA, 15 bp, Homo sapiens
atcaaactaaaaaat

SEQ ID NO: 2742 - DNA, 15 bp, Homo sapiens
tcaaactaaaaaatt

SEQ ID NO: 2743 - DNA, 15 bp, Homo sapiens
caaactaaaaaattt

SEQ ID NO: 2744 - DNA, 15 bp, Homo sapiens
aaactaaaaaatttc

SEQ ID NO: 2745 - DNA, 15 bp, Homo sapiens
aactaaaaaatttcc

SEQ ID NO: 2746 - DNA, 15 bp, Homo sapiens
actaaaaaatttcca

SEQ ID NO: 2747 - DNA, 15 bp, Homo sapiens
ctaaaaaatttccac

SEQ ID NO: 2748 - DNA, 15 bp, Homo sapiens
taaaaaatttccaca

SEQ ID NO: 2749 - DNA, 15 bp, Homo sapiens
aaaaaatttccacac

SEQ ID NO: 2750 - DNA, 15 bp, Homo sapiens
aaaaatttccacaca

SEQ ID NO: 2751 - DNA, 15 bp, Homo sapiens
aaaatttccacacaa

SEQ ID NO: 2752 - DNA, 15 bp, Homo sapiens
aaatttccacacaaa

SEQ ID NO: 2753 - DNA, 15 bp, Homo sapiens
aatttccacacaaaa

SEQ ID NO: 2754 - DNA, 15 bp, Homo sapiens
atttccacacaaaaa

SEQ ID NO: 2755 - DNA, 15 bp, Homo sapiens
tttccacacaaaaaa

SEQ ID NO: 2756 - DNA, 15 bp, Homo sapiens
ttccacacaaaaaac

SEQ ID NO: 2757 - DNA, 15 bp, Homo sapiens
tccacacaaaaaaca

SEQ ID NO: 2758 - DNA, 15 bp, Homo sapiens
ccacacaaaaaacaa

SEQ ID NO: 2759 - DNA, 15 bp, Homo sapiens
cacacaaaaaacaaa

SEQ ID NO: 2760 - DNA, 15 bp, Homo sapiens
acacaaaaaacaaaa

SEQ ID NO: 2761 - DNA, 15 bp, Homo sapiens
cacaaaaaacaaaac

SEQ ID NO: 2762 - DNA, 15 bp, Homo sapiens
acaaaaaacaaaaca

SEQ ID NO: 2763 - DNA, 15 bp, Homo sapiens
caaaaaacaaaacaa

SEQ ID NO: 2764 - DNA, 15 bp, Homo sapiens
aaaaaacaaaacaat

SEQ ID NO: 2765 - DNA, 15 bp, Homo sapiens
aaaaacaaaacaatg

SEQ ID NO: 2766 - DNA, 15 bp, Homo sapiens
aaaacaaaacaatga

SEQ ID NO: 2767 - DNA, 15 bp, Homo sapiens
aaacaaaacaatgaa

SEQ ID NO: 2768 - DNA, 15 bp, Homo sapiens
aacaaaacaatgaac

SEQ ID NO: 2769 - DNA, 15 bp, Homo sapiens
acaaaacaatgaaca

SEQ ID NO: 2770 - DNA, 15 bp, Homo sapiens
caaaacaatgaacaa

SEQ ID NO: 2771 - DNA, 15 bp, Homo sapiens
aaaacaatgaacaaa

SEQ ID NO: 2772 - DNA, 15 bp, Homo sapiens
aaacaatgaacaaat

SEQ ID NO: 2773 - DNA, 15 bp, Homo sapiens
aacaatgaacaaatg

SEQ ID NO: 2774 - DNA, 15 bp, Homo sapiens
acaatgaacaaatga

SEQ ID NO: 2775 - DNA, 15 bp, Homo sapiens
caatgaacaaatgaa

SEQ ID NO: 2776 - DNA, 15 bp, Homo sapiens
aatgaacaaatgaaa

SEQ ID NO: 2777 - DNA, 15 bp, Homo sapiens
atgaacaaatgaaag

SEQ ID NO: 2778 - DNA, 15 bp, Homo sapiens
tgaacaaatgaaagg

SEQ ID NO: 2779 - DNA, 15 bp, Homo sapiens
gaacaaatgaaaggt

SEQ ID NO: 2780 - DNA, 15 bp, Homo sapiens
aacaaatgaaaggtg

SEQ ID NO: 2781 - DNA, 15 bp, Homo sapiens
acaaatgaaaggtga

SEQ ID NO: 2782 - DNA, 15 bp, Homo sapiens
caaatgaaaggtgaa

SEQ ID NO: 2783 - DNA, 15 bp, Homo sapiens
aaatgaaaggtgaac

SEQ ID NO: 2784 - DNA, 15 bp, Homo sapiens
aatgaaaggtgaacc

SEQ ID NO: 2785 - DNA, 15 bp, Homo sapiens
atgaaaggtgaacca

SEQ ID NO: 2786 - DNA, 15 bp, Homo sapiens
tgaaaggtgaaccat

SEQ ID NO: 2787 - DNA, 15 bp, Homo sapiens
gaaaggtgaaccatg

SEQ ID NO: 2788 - DNA, 15 bp, Homo sapiens
aaaggtgaaccatga

SEQ ID NO: 2789 - DNA, 15 bp, Homo sapiens
aaggtgaaccatgaa

SEQ ID NO: 2790 - DNA, 15 bp, Homo sapiens
aggtgaaccatgaaa

SEQ ID NO: 2791 - DNA, 15 bp, Homo sapiens
ggtgaaccatgaaat

SEQ ID NO: 2792 - DNA, 15 bp, Homo sapiens
gtgaaccatgaaatg

SEQ ID NO: 2793 - DNA, 15 bp, Homo sapiens
tgaaccatgaaatgg

SEQ ID NO: 2794 - DNA, 15 bp, Homo sapiens
gaaccatgaaatggc

SEQ ID NO: 2795 - DNA, 15 bp, Homo sapiens
aaccatgaaatggca

SEQ ID NO: 2796 - DNA, 15 bp, Homo sapiens
accatgaaatggcat

SEQ ID NO: 2797 - DNA, 15 bp, Homo sapiens
ccatgaaatggcata

SEQ ID NO: 2798 - DNA, 15 bp, Homo sapiens
catgaaatggcatat

SEQ ID NO: 2799 - DNA, 15 bp, Homo sapiens
atgaaatggcatatt

SEQ ID NO: 2800 - DNA, 15 bp, Homo sapiens
tgaaatggcatattt

SEQ ID NO: 2801 - DNA, 15 bp, Homo sapiens
gaaatggcatatttg

SEQ ID NO: 2802 - DNA, 15 bp, Homo sapiens
aaatggcatatttgc

SEQ ID NO: 2803 - DNA, 15 bp, Homo sapiens
aatggcatatttgca

SEQ ID NO: 2804 - DNA, 15 bp, Homo sapiens
atggcatatttgcaa

SEQ ID NO: 2805 - DNA, 15 bp, Homo sapiens
tggcatatttgcaaa

SEQ ID NO: 2806 - DNA, 15 bp, Homo sapiens
ggcatatttgcaaac

SEQ ID NO: 2807 - DNA, 15 bp, Homo sapiens
gcatatttgcaaacc

SEQ ID NO: 2808 - DNA, 15 bp, Homo sapiens
catatttgcaaacca

SEQ ID NO: 2809 - DNA, 15 bp, Homo sapiens
atatttgcaaaccaa

SEQ ID NO: 2810 - DNA, 15 bp, Homo sapiens
tatttgcaaaccaaa

SEQ ID NO: 2811 - DNA, 15 bp, Homo sapiens
atttgcaaaccaaat

SEQ ID NO: 2812 - DNA, 15 bp, Homo sapiens
tttgcaaaccaaata

SEQ ID NO: 2813 - DNA, 15 bp, Homo sapiens
ttgcaaaccaaatat

SEQ ID NO: 2814 - DNA, 15 bp, Homo sapiens
tgcaaaccaaatatt

SEQ ID NO: 2815 - DNA, 15 bp, Homo sapiens
gcaaaccaaatattt

SEQ ID NO: 2816 - DNA, 15 bp, Homo sapiens
caaaccaaatatttc

SEQ ID NO: 2817 - DNA, 15 bp, Homo sapiens
aaaccaaatatttct

SEQ ID NO: 2818 - DNA, 15 bp, Homo sapiens
aaccaaatatttctt

SEQ ID NO: 2819 - DNA, 15 bp, Homo sapiens
accaaatatttctta

SEQ ID NO: 2820 - DNA, 15 bp, Homo sapiens
ccaaatatttcttaa

SEQ ID NO: 2821 - DNA, 15 bp, Homo sapiens
caaatatttcttaaa

SEQ ID NO: 2822 - DNA, 15 bp, Homo sapiens
aaatatttcttaaat

SEQ ID NO: 2823 - DNA, 15 bp, Homo sapiens
aatatttcttaaata

SEQ ID NO: 2824 - DNA, 15 bp, Homo sapiens
atatttcttaaatat

SEQ ID NO: 2825 - DNA, 15 bp, Homo sapiens
tatttcttaaatatt

SEQ ID NO: 2826 - DNA, 15 bp, Homo sapiens
atttcttaaatattt

SEQ ID NO: 2827 - DNA, 15 bp, Homo sapiens
tttcttaaatatttt

SEQ ID NO: 2828 - DNA, 15 bp, Homo sapiens
ttcttaaatattttg

SEQ ID NO: 2829 - DNA, 15 bp, Homo sapiens
tcttaaatattttgg

SEQ ID NO: 2830 - DNA, 15 bp, Homo sapiens
cttaaatattttggt

SEQ ID NO: 2831 - DNA, 15 bp, Homo sapiens
ttaaatattttggtt

SEQ ID NO: 2832 - DNA, 15 bp, Homo sapiens
taaatattttggtta

SEQ ID NO: 2833 - DNA, 15 bp, Homo sapiens
aaatattttggttaa

SEQ ID NO: 2834 - DNA, 15 bp, Homo sapiens
aatattttggttaat

SEQ ID NO: 2835 - DNA, 15 bp, Homo sapiens
atattttggttaata

SEQ ID NO: 2836 - DNA, 15 bp, Homo sapiens
tattttggttaatat

SEQ ID NO: 2837 - DNA, 15 bp, Homo sapiens
attttggttaatatc

SEQ ID NO: 2838 - DNA, 15 bp, Homo sapiens
ttttggttaatatcc

SEQ ID NO: 2839 - DNA, 15 bp, Homo sapiens
tttggttaatatcca

SEQ ID NO: 2840 - DNA, 15 bp, Homo sapiens
ttggttaatatccaa

SEQ ID NO: 2841 - DNA, 15 bp, Homo sapiens
tggttaatatccaaa

SEQ ID NO: 2842 - DNA, 15 bp, Homo sapiens
ggttaatatccaaaa

SEQ ID NO: 2843 - DNA, 15 bp, Homo sapiens
gttaatatccaaaat

SEQ ID NO: 2844 - DNA, 15 bp, Homo sapiens
ttaatatccaaaata

SEQ ID NO: 2845 - DNA, 15 bp, Homo sapiens
taatatccaaaatat

SEQ ID NO: 2846 - DNA, 15 bp, Homo sapiens
aatatccaaaatata

SEQ ID NO: 2847 - DNA, 15 bp, Homo sapiens
atatccaaaatatat

SEQ ID NO: 2848 - DNA, 15 bp, Homo sapiens
tatccaaaatatata

SEQ ID NO: 2849 - DNA, 15 bp, Homo sapiens
atccaaaatatataa

SEQ ID NO: 2850 - DNA, 15 bp, Homo sapiens
tccaaaatatataag

SEQ ID NO: 2851 - DNA, 15 bp, Homo sapiens
ccaaaatatataaga

SEQ ID NO: 2852 - DNA, 15 bp, Homo sapiens
caaaatatataagaa

SEQ ID NO: 2853 - DNA, 15 bp, Homo sapiens
aaaatatataagaaa

SEQ ID NO: 2854 - DNA, 15 bp, Homo sapiens
aaatatataagaaac

SEQ ID NO: 2855 - DNA, 15 bp, Homo sapiens
aatatataagaaaca

SEQ ID NO: 2856 - DNA, 15 bp, Homo sapiens
atatataagaaacac

SEQ ID NO: 2857 - DNA, 15 bp, Homo sapiens
tatataagaaacaca

SEQ ID NO: 2858 - DNA, 15 bp, Homo sapiens
atataagaaacacag

SEQ ID NO: 2859 - DNA, 15 bp, Homo sapiens
tataagaaacacaga

SEQ ID NO: 2860 - DNA, 15 bp, Homo sapiens
ataagaaacacagat

SEQ ID NO: 2861 - DNA, 15 bp, Homo sapiens
taagaaacacagatg

SEQ ID NO: 2862 - DNA, 15 bp, Homo sapiens
aagaaacacagatga

SEQ ID NO: 2863 - DNA, 15 bp, Homo sapiens
agaaacacagatgat

SEQ ID NO: 2864 - DNA, 15 bp, Homo sapiens
gaaacacagatgatt

SEQ ID NO: 2865 - DNA, 15 bp, Homo sapiens
aaacacagatgattc

SEQ ID NO: 2866 - DNA, 15 bp, Homo sapiens
aacacagatgattca

SEQ ID NO: 2867 - DNA, 15 bp, Homo sapiens
acacagatgattcaa

SEQ ID NO: 2868 - DNA, 15 bp, Homo sapiens
cacagatgattcaat

SEQ ID NO: 2869 - DNA, 15 bp, Homo sapiens
acagatgattcaata

SEQ ID NO: 2870 - DNA, 15 bp, Homo sapiens
cagatgattcaataa

SEQ ID NO: 2871 - DNA, 15 bp, Homo sapiens
agatgattcaataac

SEQ ID NO: 2872 - DNA, 15 bp, Homo sapiens
gatgattcaataaca

SEQ ID NO: 2873 - DNA, 15 bp, Homo sapiens
atgattcaataacaa

SEQ ID NO: 2874 - DNA, 15 bp, Homo sapiens
tgattcaataacaaa

SEQ ID NO: 2875 - DNA, 15 bp, Homo sapiens
gattcaataacaaac

SEQ ID NO: 2876 - DNA, 15 bp, Homo sapiens
attcaataacaaaca

SEQ ID NO: 2877 - DNA, 15 bp, Homo sapiens
ttcaataacaaacaa

SEQ ID NO: 2878 - DNA, 15 bp, Homo sapiens
tcaataacaaacaaa

SEQ ID NO: 2879 - DNA, 15 bp, Homo sapiens
caataacaaacaaaa

SEQ ID NO: 2880 - DNA, 15 bp, Homo sapiens
aataacaaacaaaaa

SEQ ID NO: 2881 - DNA, 15 bp, Homo sapiens
ataacaaacaaaaaa

SEQ ID NO: 2882 - DNA, 15 bp, Homo sapiens
taacaaacaaaaaat

SEQ ID NO: 2883 - DNA, 15 bp, Homo sapiens
aacaaacaaaaaatt

SEQ ID NO: 2884 - DNA, 15 bp, Homo sapiens
acaaacaaaaaatta

SEQ ID NO: 2885 - DNA, 15 bp, Homo sapiens
caaacaaaaaattaa

SEQ ID NO: 2886 - DNA, 15 bp, Homo sapiens
aaacaaaaaattaaa

SEQ ID NO: 2887 - DNA, 15 bp, Homo sapiens
aacaaaaaattaaaa

SEQ ID NO: 2888 - DNA, 15 bp, Homo sapiens
acaaaaaattaaaaa

SEQ ID NO: 2889 - DNA, 15 bp, Homo sapiens
caaaaaattaaaaat

SEQ ID NO: 2890 - DNA, 15 bp, Homo sapiens
aaaaaattaaaaata

SEQ ID NO: 2891 - DNA, 15 bp, Homo sapiens
aaaaattaaaaatag

SEQ ID NO: 2892 - DNA, 15 bp, Homo sapiens
aaaattaaaaatagg

SEQ ID NO: 2893 - DNA, 15 bp, Homo sapiens
aaattaaaaatagga

SEQ ID NO: 2894 - DNA, 15 bp, Homo sapiens
aattaaaaataggaa

SEQ ID NO: 2895 - DNA, 15 bp, Homo sapiens
attaaaaataggaaa

SEQ ID NO: 2896 - DNA, 15 bp, Homo sapiens
ttaaaaataggaaaa

SEQ ID NO: 2897 - DNA, 15 bp, Homo sapiens
taaaaataggaaaat

SEQ ID NO: 2898 - DNA, 15 bp, Homo sapiens
aaaaataggaaaata

SEQ ID NO: 2899 - DNA, 15 bp, Homo sapiens
aaaataggaaaataa

SEQ ID NO: 2900 - DNA, 15 bp, Homo sapiens
aaataggaaaataaa

SEQ ID NO: 2901 - DNA, 15 bp, Homo sapiens
aataggaaaataaaa

SEQ ID NO: 2902 - DNA, 15 bp, Homo sapiens
ataggaaaataaaaa

SEQ ID NO: 2903 - DNA, 15 bp, Homo sapiens
taggaaaataaaaaa

SEQ ID NO: 2904 - DNA, 15 bp, Homo sapiens
aggaaaataaaaaaa

SEQ ID NO: 2905 - DNA, 15 bp, Homo sapiens
ggaaaataaaaaaat

SEQ ID NO: 2906 - DNA, 15 bp, Homo sapiens
gaaaataaaaaaatt

SEQ ID NO: 2907 - DNA, 15 bp, Homo sapiens
aaaataaaaaaatta

SEQ ID NO: 2908 - DNA, 15 bp, Homo sapiens
aaataaaaaaattaa

SEQ ID NO: 2909 - DNA, 15 bp, Homo sapiens
aataaaaaaattaaa

SEQ ID NO: 2910 - DNA, 15 bp, Homo sapiens
ataaaaaaattaaaa

SEQ ID NO: 2911 - DNA, 15 bp, Homo sapiens
taaaaaaattaaaaa

SEQ ID NO: 2912 - DNA, 15 bp, Homo sapiens
aaaaaaattaaaaag

SEQ ID NO: 2913 - DNA, 15 bp, Homo sapiens
aaaaaattaaaaaga

SEQ ID NO: 2914 - DNA, 15 bp, Homo sapiens
aaaaattaaaaagaa

SEQ ID NO: 2915 - DNA, 15 bp, Homo sapiens
aaaattaaaaagaag

SEQ ID NO: 2916 - DNA, 15 bp, Homo sapiens
aaattaaaaagaaga

SEQ ID NO: 2917 - DNA, 15 bp, Homo sapiens
aattaaaaagaagaa

SEQ ID NO: 2918 - DNA, 15 bp, Homo sapiens
attaaaaagaagaaa

SEQ ID NO: 2919 - DNA, 15 bp, Homo sapiens
ttaaaaagaagaaaa

SEQ ID NO: 2920 - DNA, 15 bp, Homo sapiens
taaaaagaagaaaat

SEQ ID NO: 2921 - DNA, 15 bp, Homo sapiens
aaaaagaagaaaatc

SEQ ID NO: 2922 - DNA, 15 bp, Homo sapiens
aaaagaagaaaatcc

SEQ ID NO: 2923 - DNA, 15 bp, Homo sapiens
aaagaagaaaatcct

SEQ ID NO: 2924 - DNA, 15 bp, Homo sapiens
aagaagaaaatcctg

SEQ ID NO: 2925 - DNA, 15 bp, Homo sapiens
agaagaaaatcctgc

SEQ ID NO: 2926 - DNA, 15 bp, Homo sapiens
gaagaaaatcctgcc

SEQ ID NO: 2927 - DNA, 15 bp, Homo sapiens
aagaaaatcctgcca

SEQ ID NO: 2928 - DNA, 15 bp, Homo sapiens
agaaaatcctgccat

SEQ ID NO: 2929 - DNA, 15 bp, Homo sapiens
gaaaatcctgccatt

SEQ ID NO: 2930 - DNA, 15 bp, Homo sapiens
aaaatcctgccattt

SEQ ID NO: 2931 - DNA, 15 bp, Homo sapiens
aaatcctgccattta

SEQ ID NO: 2932 - DNA, 15 bp, Homo sapiens
aatcctgccatttat

SEQ ID NO: 2933 - DNA, 15 bp, Homo sapiens
atcctgccatttatg

SEQ ID NO: 2934 - DNA, 15 bp, Homo sapiens
tcctgccatttatgg

SEQ ID NO: 2935 - DNA, 15 bp, Homo sapiens
cctgccatttatggc

SEQ ID NO: 2936 - DNA, 15 bp, Homo sapiens
ctgccatttatggca

SEQ ID NO: 2937 - DNA, 15 bp, Homo sapiens
tgccatttatggcag

SEQ ID NO: 2938 - DNA, 15 bp, Homo sapiens
gccatttatggcaga

SEQ ID NO: 2939 - DNA, 15 bp, Homo sapiens
ccatttatggcagaa

SEQ ID NO: 2940 - DNA, 15 bp, Homo sapiens
catttatggcagaat

SEQ ID NO: 2941 - DNA, 15 bp, Homo sapiens
atttatggcagaatt

SEQ ID NO: 2942 - DNA, 15 bp, Homo sapiens
tttatggcagaattg

SEQ ID NO: 2943 - DNA, 15 bp, Homo sapiens
ttatggcagaattga

SEQ ID NO: 2944 - DNA, 15 bp, Homo sapiens
tatggcagaattgat

SEQ ID NO: 2945 - DNA, 15 bp, Homo sapiens
atggcagaattgatg

SEQ ID NO: 2946 - DNA, 15 bp, Homo sapiens
tggcagaattgatga

SEQ ID NO: 2947 - DNA, 15 bp, Homo sapiens
ggcagaattgatgaa

SEQ ID NO: 2948 - DNA, 15 bp, Homo sapiens
gcagaattgatgaac

SEQ ID NO: 2949 - DNA, 15 bp, Homo sapiens
cagaattgatgaacc

SEQ ID NO: 2950 - DNA, 15 bp, Homo sapiens
agaattgatgaacct

SEQ ID NO: 2951 - DNA, 15 bp, Homo sapiens
gaattgatgaacctg

SEQ ID NO: 2952 - DNA, 15 bp, Homo sapiens
aattgatgaacctgg

SEQ ID NO: 2953 - DNA, 15 bp, Homo sapiens
attgatgaacctgga

SEQ ID NO: 2954 - DNA, 15 bp, Homo sapiens
ttgatgaacctggag

SEQ ID NO: 2955 - DNA, 15 bp, Homo sapiens
tgatgaacctggagg

SEQ ID NO: 2956 - DNA, 15 bp, Homo sapiens
gatgaacctggagga

SEQ ID NO: 2957 - DNA, 15 bp, Homo sapiens
atgaacctggaggat

SEQ ID NO: 2958 - DNA, 15 bp, Homo sapiens
tgaacctggaggatg

SEQ ID NO: 2959 - DNA, 15 bp, Homo sapiens
gaacctggaggatgt

SEQ ID NO: 2960 - DNA, 15 bp, Homo sapiens
aacctggaggatgta

SEQ ID NO: 2961 - DNA, 15 bp, Homo sapiens
acctggaggatgtaa

SEQ ID NO: 2962 - DNA, 15 bp, Homo sapiens
cctggaggatgtaaa

SEQ ID NO: 2963 - DNA, 15 bp, Homo sapiens
ctggaggatgtaaaa

SEQ ID NO: 2964 - DNA, 15 bp, Homo sapiens
tggaggatgtaaaac

SEQ ID NO: 2965 - DNA, 15 bp, Homo sapiens
ggaggatgtaaaact

SEQ ID NO: 2966 - DNA, 15 bp, Homo sapiens
gaggatgtaaaacta

SEQ ID NO: 2967 - DNA, 15 bp, Homo sapiens
aggatgtaaaactaa

SEQ ID NO: 2968 - DNA, 15 bp, Homo sapiens
ggatgtaaaactaag

SEQ ID NO: 2969 - DNA, 15 bp, Homo sapiens
gatgtaaaactaaga

SEQ ID NO: 2970 - DNA, 15 bp, Homo sapiens
atgtaaaactaagaa

SEQ ID NO: 2971 - DNA, 15 bp, Homo sapiens
tgtaaaactaagaaa

SEQ ID NO: 2972 - DNA, 15 bp, Homo sapiens
gtaaaactaagaaaa

SEQ ID NO: 2973 - DNA, 15 bp, Homo sapiens
taaaactaagaaaaa

SEQ ID NO: 2974 - DNA, 15 bp, Homo sapiens
aaaactaagaaaaat

SEQ ID NO: 2975 - DNA, 15 bp, Homo sapiens
aaactaagaaaaata

SEQ ID NO: 2976 - DNA, 15 bp, Homo sapiens
aactaagaaaaataa

SEQ ID NO: 2977 - DNA, 15 bp, Homo sapiens
actaagaaaaataag

SEQ ID NO: 2978 - DNA, 15 bp, Homo sapiens
ctaagaaaaataagc

SEQ ID NO: 2979 - DNA, 15 bp, Homo sapiens
taagaaaaataagcc

SEQ ID NO: 2980 - DNA, 15 bp, Homo sapiens
aagaaaaataagcct

SEQ ID NO: 2981 - DNA, 15 bp, Homo sapiens
agaaaaataagcctg

SEQ ID NO: 2982 - DNA, 15 bp, Homo sapiens
gaaaaataagcctga

SEQ ID NO: 2983 - DNA, 15 bp, Homo sapiens
aaaaataagcctgac

SEQ ID NO: 2984 - DNA, 15 bp, Homo sapiens
aaaataagcctgaca

SEQ ID NO: 2985 - DNA, 15 bp, Homo sapiens
aaataagcctgacac

SEQ ID NO: 2986 - DNA, 15 bp, Homo sapiens
aataagcctgacaca

SEQ ID NO: 2987 - DNA, 15 bp, Homo sapiens
ataagcctgacacaa

SEQ ID NO: 2988 - DNA, 15 bp, Homo sapiens
taagcctgacacaaa

SEQ ID NO: 2989 - DNA, 15 bp, Homo sapiens
aagcctgacacaaaa

SEQ ID NO: 2990 - DNA, 15 bp, Homo sapiens
agcctgacacaaaaa

SEQ ID NO: 2991 - DNA, 15 bp, Homo sapiens
gcctgacacaaaaag

SEQ ID NO: 2992 - DNA, 15 bp, Homo sapiens
cctgacacaaaaaga

SEQ ID NO: 2993 - DNA, 15 bp, Homo sapiens
ctgacacaaaaagac

SEQ ID NO: 2994 - DNA, 15 bp, Homo sapiens
tgacacaaaaagaca

SEQ ID NO: 2995 - DNA, 15 bp, Homo sapiens
gacacaaaaagacaa

SEQ ID NO: 2996 - DNA, 15 bp, Homo sapiens
acacaaaaagacaaa

SEQ ID NO: 2997 - DNA, 15 bp, Homo sapiens
cacaaaaagacaaat

SEQ ID NO: 2998 - DNA, 15 bp, Homo sapiens
acaaaaagacaaata

SEQ ID NO: 2999 - DNA, 15 bp, Homo sapiens
caaaaagacaaatac

SEQ ID NO: 3000 - DNA, 15 bp, Homo sapiens
aaaaagacaaatact

SEQ ID NO: 3001 - DNA, 15 bp, Homo sapiens
aaaagacaaatacta

SEQ ID NO: 3002 - DNA, 15 bp, Homo sapiens
aaagacaaatactac

SEQ ID NO: 3003 - DNA, 15 bp, Homo sapiens
aagacaaatactaca

SEQ ID NO: 3004 - DNA, 15 bp, Homo sapiens
agacaaatactacac

SEQ ID NO: 3005 - DNA, 15 bp, Homo sapiens
gacaaatactacaca

SEQ ID NO: 3006 - DNA, 15 bp, Homo sapiens
acaaatactacacaa

SEQ ID NO: 3007 - DNA, 15 bp, Homo sapiens
caaatactacacaac

SEQ ID NO: 3008 - DNA, 15 bp, Homo sapiens
aaatactacacaacc

SEQ ID NO: 3009 - DNA, 15 bp, Homo sapiens
aatactacacaacct

SEQ ID NO: 3010 - DNA, 15 bp, Homo sapiens
atactacacaacctt

SEQ ID NO: 3011 - DNA, 15 bp, Homo sapiens
tactacacaaccttg

SEQ ID NO: 3012 - DNA, 15 bp, Homo sapiens
actacacaaccttgc

SEQ ID NO: 3013 - DNA, 15 bp, Homo sapiens
ctacacaaccttgct

SEQ ID NO: 3014 - DNA, 15 bp, Homo sapiens
tacacaaccttgctc

SEQ ID NO: 3015 - DNA, 15 bp, Homo sapiens
acacaaccttgctca

SEQ ID NO: 3016 - DNA, 15 bp, Homo sapiens
cacaaccttgctcat

SEQ ID NO: 3017 - DNA, 15 bp, Homo sapiens
acaaccttgctcata

SEQ ID NO: 3018 - DNA, 15 bp, Homo sapiens
caaccttgctcatat

SEQ ID NO: 3019 - DNA, 15 bp, Homo sapiens
aaccttgctcatatg

SEQ ID NO: 3020 - DNA, 15 bp, Homo sapiens
accttgctcatatgt

SEQ ID NO: 3021 - DNA, 15 bp, Homo sapiens
ccttgctcatatgtg

SEQ ID NO: 3022 - DNA, 15 bp, Homo sapiens
cttgctcatatgtga

SEQ ID NO: 3023 - DNA, 15 bp, Homo sapiens
ttgctcatatgtgaa

SEQ ID NO: 3024 - DNA, 15 bp, Homo sapiens
tgctcatatgtgaaa

SEQ ID NO: 3025 - DNA, 15 bp, Homo sapiens
gctcatatgtgaaac

SEQ ID NO: 3026 - DNA, 15 bp, Homo sapiens
ctcatatgtgaaaca

SEQ ID NO: 3027 - DNA, 15 bp, Homo sapiens
tcatatgtgaaacat

SEQ ID NO: 3028 - DNA, 15 bp, Homo sapiens
catatgtgaaacata

SEQ ID NO: 3029 - DNA, 15 bp, Homo sapiens
atatgtgaaacataa

SEQ ID NO: 3030 - DNA, 15 bp, Homo sapiens
tatgtgaaacataaa

SEQ ID NO: 3031 - DNA, 15 bp, Homo sapiens
atgtgaaacataaaa

SEQ ID NO: 3032 - DNA, 15 bp, Homo sapiens
tgtgaaacataaaaa

SEQ ID NO: 3033 - DNA, 15 bp, Homo sapiens
gtgaaacataaaaaa

SEQ ID NO: 3034 - DNA, 15 bp, Homo sapiens
tgaaacataaaaaag

SEQ ID NO: 3035 - DNA, 15 bp, Homo sapiens
gaaacataaaaaagt

SEQ ID NO: 3036 - DNA, 15 bp, Homo sapiens
aaacataaaaaagtc

SEQ ID NO: 3037 - DNA, 15 bp, Homo sapiens
aacataaaaaagtca

SEQ ID NO: 3038 - DNA, 15 bp, Homo sapiens
acataaaaaagtcac

SEQ ID NO: 3039 - DNA, 15 bp, Homo sapiens
cataaaaaagtcact

SEQ ID NO: 3040 - DNA, 15 bp, Homo sapiens
ataaaaaagtcactc

SEQ ID NO: 3041 - DNA, 15 bp, Homo sapiens
taaaaaagtcactct

SEQ ID NO: 3042 - DNA, 15 bp, Homo sapiens
aaaaaagtcactctc

SEQ ID NO: 3043 - DNA, 15 bp, Homo sapiens
aaaaagtcactctca

SEQ ID NO: 3044 - DNA, 15 bp, Homo sapiens
aaaagtcactctcat

SEQ ID NO: 3045 - DNA, 15 bp, Homo sapiens
aaagtcactctcatg

SEQ ID NO: 3046 - DNA, 15 bp, Homo sapiens
aagtcactctcatgg

SEQ ID NO: 3047 - DNA, 15 bp, Homo sapiens
agtcactctcatgga

SEQ ID NO: 3048 - DNA, 15 bp, Homo sapiens
gtcactctcatggaa

SEQ ID NO: 3049 - DNA, 15 bp, Homo sapiens
tcactctcatggaaa

SEQ ID NO: 3050 - DNA, 15 bp, Homo sapiens
cactctcatggaaac

SEQ ID NO: 3051 - DNA, 15 bp, Homo sapiens
actctcatggaaaca

SEQ ID NO: 3052 - DNA, 15 bp, Homo sapiens
ctctcatggaaacag

SEQ ID NO: 3053 - DNA, 15 bp, Homo sapiens
tctcatggaaacaga

SEQ ID NO: 3054 - DNA, 15 bp, Homo sapiens
ctcatggaaacagac

SEQ ID NO: 3055 - DNA, 15 bp, Homo sapiens
tcatggaaacagaca

SEQ ID NO: 3056 - DNA, 15 bp, Homo sapiens
catggaaacagacag

SEQ ID NO: 3057 - DNA, 15 bp, Homo sapiens
atggaaacagacagt

SEQ ID NO: 3058 - DNA, 15 bp, Homo sapiens
tggaaacagacagta

SEQ ID NO: 3059 - DNA, 15 bp, Homo sapiens
ggaaacagacagtag

SEQ ID NO: 3060 - DNA, 15 bp, Homo sapiens
gaaacagacagtaga

SEQ ID NO: 3061 - DNA, 15 bp, Homo sapiens
aaacagacagtagag

SEQ ID NO: 3062 - DNA, 15 bp, Homo sapiens
aacagacagtagagg

SEQ ID NO: 3063 - DNA, 15 bp, Homo sapiens
acagacagtagaggt

SEQ ID NO: 3064 - DNA, 15 bp, Homo sapiens
cagacagtagaggta

SEQ ID NO: 3065 - DNA, 15 bp, Homo sapiens
agacagtagaggtat

SEQ ID NO: 3066 - DNA, 15 bp, Homo sapiens
gacagtagaggtatg

SEQ ID NO: 3067 - DNA, 15 bp, Homo sapiens
acagtagaggtatgg

SEQ ID NO: 3068 - DNA, 15 bp, Homo sapiens
cagtagaggtatggt

SEQ ID NO: 3069 - DNA, 15 bp, Homo sapiens
agtagaggtatggtt

SEQ ID NO: 3070 - DNA, 15 bp, Homo sapiens
gtagaggtatggttt

SEQ ID NO: 3071 - DNA, 15 bp, Homo sapiens
tagaggtatggtttc

SEQ ID NO: 3072 - DNA, 15 bp, Homo sapiens
agaggtatggtttcc

SEQ ID NO: 3073 - DNA, 15 bp, Homo sapiens
gaggtatggtttcca

SEQ ID NO: 3074 - DNA, 15 bp, Homo sapiens
aggtatggtttccag

SEQ ID NO: 3075 - DNA, 15 bp, Homo sapiens
ggtatggtttccagg

SEQ ID NO: 3076 - DNA, 15 bp, Homo sapiens
gtatggtttccaggg

SEQ ID NO: 3077 - DNA, 15 bp, Homo sapiens
tatggtttccagggg

SEQ ID NO: 3078 - DNA, 15 bp, Homo sapiens
atggtttccaggggt

SEQ ID NO: 3079 - DNA, 15 bp, Homo sapiens
tggtttccaggggtt

SEQ ID NO: 3080 - DNA, 15 bp, Homo sapiens
ggtttccaggggttg

SEQ ID NO: 3081 - DNA, 15 bp, Homo sapiens
gtttccaggggttgg

SEQ ID NO: 3082 - DNA, 15 bp, Homo sapiens
tttccaggggttggg

SEQ ID NO: 3083 - DNA, 15 bp, Homo sapiens
ttccaggggttgggg

SEQ ID NO: 3084 - DNA, 15 bp, Homo sapiens
tccaggggttggggg

SEQ ID NO: 3085 - DNA, 15 bp, Homo sapiens
ccaggggttgggggt

SEQ ID NO: 3086 - DNA, 15 bp, Homo sapiens
caggggttgggggtg

SEQ ID NO: 3087 - DNA, 15 bp, Homo sapiens
aggggttgggggtgg

SEQ ID NO: 3088 - DNA, 15 bp, Homo sapiens
ggggttgggggtggg

SEQ ID NO: 3089 - DNA, 15 bp, Homo sapiens
gggttgggggtggga

SEQ ID NO: 3090 - DNA, 15 bp, Homo sapiens
ggttgggggtgggag

SEQ ID NO: 3091 - DNA, 15 bp, Homo sapiens
gttgggggtgggaga

SEQ ID NO: 3092 - DNA, 15 bp, Homo sapiens
ttgggggtgggagaa

SEQ ID NO: 3093 - DNA, 15 bp, Homo sapiens
tgggggtgggagaat

SEQ ID NO: 3094 - DNA, 15 bp, Homo sapiens
gggggtgggagaatc

SEQ ID NO: 3095 - DNA, 15 bp, Homo sapiens
ggggtgggagaatca

SEQ ID NO: 3096 - DNA, 15 bp, Homo sapiens
gggtgggagaatcag

SEQ ID NO: 3097 - DNA, 15 bp, Homo sapiens
ggtgggagaatcagg

SEQ ID NO: 3098 - DNA, 15 bp, Homo sapiens
gtgggagaatcagga

SEQ ID NO: 3099 - DNA, 15 bp, Homo sapiens
tgggagaatcaggaa

SEQ ID NO: 3100 - DNA, 15 bp, Homo sapiens
gggagaatcaggaaa

SEQ ID NO: 3101 - DNA, 15 bp, Homo sapiens
ggagaatcaggaaac

SEQ ID NO: 3102 - DNA, 15 bp, Homo sapiens
gagaatcaggaaact

SEQ ID NO: 3103 - DNA, 15 bp, Homo sapiens
agaatcaggaaacta

SEQ ID NO: 3104 - DNA, 15 bp, Homo sapiens
gaatcaggaaactat

SEQ ID NO: 3105 - DNA, 15 bp, Homo sapiens
aatcaggaaactatt

SEQ ID NO: 3106 - DNA, 15 bp, Homo sapiens
atcaggaaactatta

SEQ ID NO: 3107 - DNA, 15 bp, Homo sapiens
tcaggaaactattac

SEQ ID NO: 3108 - DNA, 15 bp, Homo sapiens
caggaaactattact

SEQ ID NO: 3109 - DNA, 15 bp, Homo sapiens
aggaaactattactc

SEQ ID NO: 3110 - DNA, 15 bp, Homo sapiens
ggaaactattactca

SEQ ID NO: 3111 - DNA, 15 bp, Homo sapiens
gaaactattactcaa

SEQ ID NO: 3112 - DNA, 15 bp, Homo sapiens
aaactattactcaaa

SEQ ID NO: 3113 - DNA, 15 bp, Homo sapiens
aactattactcaaag

SEQ ID NO: 3114 - DNA, 15 bp, Homo sapiens
actattactcaaagg

SEQ ID NO: 3115 - DNA, 15 bp, Homo sapiens
ctattactcaaaggg

SEQ ID NO: 3116 - DNA, 15 bp, Homo sapiens
tattactcaaagggt

SEQ ID NO: 3117 - DNA, 15 bp, Homo sapiens
attactcaaagggta

SEQ ID NO: 3118 - DNA, 15 bp, Homo sapiens
ttactcaaagggtat

SEQ ID NO: 3119 - DNA, 15 bp, Homo sapiens
tactcaaagggtata

SEQ ID NO: 3120 - DNA, 15 bp, Homo sapiens
actcaaagggtataa

SEQ ID NO: 3121 - DNA, 15 bp, Homo sapiens
ctcaaagggtataaa

SEQ ID NO: 3122 - DNA, 15 bp, Homo sapiens
tcaaagggtataaaa

SEQ ID NO: 3123 - DNA, 15 bp, Homo sapiens
caaagggtataaaat

SEQ ID NO: 3124 - DNA, 15 bp, Homo sapiens
aaagggtataaaatt

SEQ ID NO: 3125 - DNA, 15 bp, Homo sapiens
aagggtataaaattt

SEQ ID NO: 3126 - DNA, 15 bp, Homo sapiens
agggtataaaatttc

SEQ ID NO: 3127 - DNA, 15 bp, Homo sapiens
gggtataaaatttca

SEQ ID NO: 3128 - DNA, 15 bp, Homo sapiens
ggtataaaatttcag

SEQ ID NO: 3129 - DNA, 15 bp, Homo sapiens
gtataaaatttcagt

SEQ ID NO: 3130 - DNA, 15 bp, Homo sapiens
tataaaatttcagtt

SEQ ID NO: 3131 - DNA, 15 bp, Homo sapiens
ataaaatttcagtta

SEQ ID NO: 3132 - DNA, 15 bp, Homo sapiens
taaaatttcagttat

SEQ ID NO: 3133 - DNA, 15 bp, Homo sapiens
aaaatttcagttatg

SEQ ID NO: 3134 - DNA, 15 bp, Homo sapiens
aaatttcagttatgt

SEQ ID NO: 3135 - DNA, 15 bp, Homo sapiens
aatttcagttatgtg

SEQ ID NO: 3136 - DNA, 15 bp, Homo sapiens
atttcagttatgtgg

SEQ ID NO: 3137 - DNA, 15 bp, Homo sapiens
tttcagttatgtggg

SEQ ID NO: 3138 - DNA, 15 bp, Homo sapiens
ttcagttatgtggga

SEQ ID NO: 3139 - DNA, 15 bp, Homo sapiens
tcagttatgtgggat

SEQ ID NO: 3140 - DNA, 15 bp, Homo sapiens
cagttatgtgggatg

SEQ ID NO: 3141 - DNA, 15 bp, Homo sapiens
agttatgtgggatga

SEQ ID NO: 3142 - DNA, 15 bp, Homo sapiens
gttatgtgggatgaa

SEQ ID NO: 3143 - DNA, 15 bp, Homo sapiens
ttatgtgggatgaat

SEQ ID NO: 3144 - DNA, 15 bp, Homo sapiens
tatgtgggatgaata

SEQ ID NO: 3145 - DNA, 15 bp, Homo sapiens
atgtgggatgaataa

SEQ ID NO: 3146 - DNA, 15 bp, Homo sapiens
tgtgggatgaataaa

SEQ ID NO: 3147 - DNA, 15 bp, Homo sapiens
gtgggatgaataaat

SEQ ID NO: 3148 - DNA, 15 bp, Homo sapiens
tgggatgaataaatt

SEQ ID NO: 3149 - DNA, 15 bp, Homo sapiens
gggatgaataaattc

SEQ ID NO: 3150 - DNA, 15 bp, Homo sapiens
ggatgaataaattct

SEQ ID NO: 3151 - DNA, 15 bp, Homo sapiens
gatgaataaattcta

SEQ ID NO: 3152 - DNA, 15 bp, Homo sapiens
atgaataaattctag

SEQ ID NO: 3153 - DNA, 15 bp, Homo sapiens
tgaataaattctaga

SEQ ID NO: 3154 - DNA, 15 bp, Homo sapiens
gaataaattctagat

SEQ ID NO: 3155 - DNA, 15 bp, Homo sapiens
aataaattctagata

SEQ ID NO: 3156 - DNA, 15 bp, Homo sapiens
ataaattctagatat

SEQ ID NO: 3157 - DNA, 15 bp, Homo sapiens
taaattctagatatc

SEQ ID NO: 3158 - DNA, 15 bp, Homo sapiens
aaattctagatatct

SEQ ID NO: 3159 - DNA, 15 bp, Homo sapiens
aattctagatatcta

SEQ ID NO: 3160 - DNA, 15 bp, Homo sapiens
attctagatatctaa

SEQ ID NO: 3161 - DNA, 15 bp, Homo sapiens
ttctagatatctaat

SEQ ID NO: 3162 - DNA, 15 bp, Homo sapiens
tctagatatctaatg

SEQ ID NO: 3163 - DNA, 15 bp, Homo sapiens
ctagatatctaatgt

SEQ ID NO: 3164 - DNA, 15 bp, Homo sapiens
tagatatctaatgta

SEQ ID NO: 3165 - DNA, 15 bp, Homo sapiens
agatatctaatgtac

SEQ ID NO: 3166 - DNA, 15 bp, Homo sapiens
gatatctaatgtaca

SEQ ID NO: 3167 - DNA, 15 bp, Homo sapiens
atatctaatgtacag

SEQ ID NO: 3168 - DNA, 15 bp, Homo sapiens
tatctaatgtacagc

SEQ ID NO: 3169 - DNA, 15 bp, Homo sapiens
atctaatgtacagca

SEQ ID NO: 3170 - DNA, 15 bp, Homo sapiens
tctaatgtacagcat

SEQ ID NO: 3171 - DNA, 15 bp, Homo sapiens
ctaatgtacagcatc

SEQ ID NO: 3172 - DNA, 15 bp, Homo sapiens
taatgtacagcatcg

SEQ ID NO: 3173 - DNA, 15 bp, Homo sapiens
aatgtacagcatcgt

SEQ ID NO: 3174 - DNA, 15 bp, Homo sapiens
atgtacagcatcgtg

SEQ ID NO: 3175 - DNA, 15 bp, Homo sapiens
tgtacagcatcgtga

SEQ ID NO: 3176 - DNA, 15 bp, Homo sapiens
gtacagcatcgtgac

SEQ ID NO: 3177 - DNA, 15 bp, Homo sapiens
tacagcatcgtgact

SEQ ID NO: 3178 - DNA, 15 bp, Homo sapiens
acagcatcgtgactg

SEQ ID NO: 3179 - DNA, 15 bp, Homo sapiens
cagcatcgtgactgt

SEQ ID NO: 3180 - DNA, 15 bp, Homo sapiens
agcatcgtgactgta

SEQ ID NO: 3181 - DNA, 15 bp, Homo sapiens
gcatcgtgactgtag

SEQ ID NO: 3182 - DNA, 15 bp, Homo sapiens
catcgtgactgtagt

SEQ ID NO: 3183 - DNA, 15 bp, Homo sapiens
atcgtgactgtagtt

SEQ ID NO: 3184 - DNA, 15 bp, Homo sapiens
tcgtgactgtagtta

SEQ ID NO: 3185 - DNA, 15 bp, Homo sapiens
cgtgactgtagttaa

SEQ ID NO: 3186 - DNA, 15 bp, Homo sapiens
gtgactgtagttaat

SEQ ID NO: 3187 - DNA, 15 bp, Homo sapiens
tgactgtagttaatt

SEQ ID NO: 3188 - DNA, 15 bp, Homo sapiens
gactgtagttaattg

SEQ ID NO: 3189 - DNA, 15 bp, Homo sapiens
actgtagttaattgt

SEQ ID NO: 3190 - DNA, 15 bp, Homo sapiens
ctgtagttaattgta

SEQ ID NO: 3191 - DNA, 15 bp, Homo sapiens
tgtagttaattgtac

SEQ ID NO: 3192 - DNA, 15 bp, Homo sapiens
gtagttaattgtact

SEQ ID NO: 3193 - DNA, 15 bp, Homo sapiens
tagttaattgtactg

SEQ ID NO: 3194 - DNA, 15 bp, Homo sapiens
agttaattgtactgt

SEQ ID NO: 3195 - DNA, 15 bp, Homo sapiens
gttaattgtactgta

SEQ ID NO: 3196 - DNA, 15 bp, Homo sapiens
ttaattgtactgtaa

SEQ ID NO: 3197 - DNA, 15 bp, Homo sapiens
taattgtactgtaag

SEQ ID NO: 3198 - DNA, 15 bp, Homo sapiens
aattgtactgtaagt

SEQ ID NO: 3199 - DNA, 15 bp, Homo sapiens
attgtactgtaagta

SEQ ID NO: 3200 - DNA, 15 bp, Homo sapiens
ttgtactgtaagtat

SEQ ID NO: 3201 - DNA, 15 bp, Homo sapiens
tgtactgtaagtata

SEQ ID NO: 3202 - DNA, 15 bp, Homo sapiens
gtactgtaagtatat

SEQ ID NO: 3203 - DNA, 15 bp, Homo sapiens
tactgtaagtatatt

SEQ ID NO: 3204 - DNA, 15 bp, Homo sapiens
actgtaagtatattt

SEQ ID NO: 3205 - DNA, 15 bp, Homo sapiens
ctgtaagtatattta

SEQ ID NO: 3206 - DNA, 15 bp, Homo sapiens
tgtaagtatatttaa

SEQ ID NO: 3207 - DNA, 15 bp, Homo sapiens
gtaagtatatttaaa

SEQ ID NO: 3208 - DNA, 15 bp, Homo sapiens
taagtatatttaaaa

SEQ ID NO: 3209 - DNA, 15 bp, Homo sapiens
aagtatatttaaaat

SEQ ID NO: 3210 - DNA, 15 bp, Homo sapiens
agtatatttaaaatt

SEQ ID NO: 3211 - DNA, 15 bp, Homo sapiens
gtatatttaaaattt

SEQ ID NO: 3212 - DNA, 15 bp, Homo sapiens
tatatttaaaatttg

SEQ ID NO: 3213 - DNA, 15 bp, Homo sapiens
atatttaaaatttgc

SEQ ID NO: 3214 - DNA, 15 bp, Homo sapiens
tatttaaaatttgca

SEQ ID NO: 3215 - DNA, 15 bp, Homo sapiens
atttaaaatttgcaa

SEQ ID NO: 3216 - DNA, 15 bp, Homo sapiens
tttaaaatttgcaaa

SEQ ID NO: 3217 - DNA, 15 bp, Homo sapiens
ttaaaatttgcaaag

SEQ ID NO: 3218 - DNA, 15 bp, Homo sapiens
taaaatttgcaaaga

SEQ ID NO: 3219 - DNA, 15 bp, Homo sapiens
aaaatttgcaaagag

SEQ ID NO: 3220 - DNA, 15 bp, Homo sapiens
aaatttgcaaagaga

SEQ ID NO: 3221 - DNA, 15 bp, Homo sapiens
aatttgcaaagagag

SEQ ID NO: 3222 - DNA, 15 bp, Homo sapiens
atttgcaaagagagt

SEQ ID NO: 3223 - DNA, 15 bp, Homo sapiens
tttgcaaagagagta

SEQ ID NO: 3224 - DNA, 15 bp, Homo sapiens
ttgcaaagagagtag

SEQ ID NO: 3225 - DNA, 15 bp, Homo sapiens
tgcaaagagagtaga

SEQ ID NO: 3226 - DNA, 15 bp, Homo sapiens
gcaaagagagtagat

SEQ ID NO: 3227 - DNA, 15 bp, Homo sapiens
caaagagagtagatt

SEQ ID NO: 3228 - DNA, 15 bp, Homo sapiens
aaagagagtagattt

SEQ ID NO: 3229 - DNA, 15 bp, Homo sapiens
aagagagtagatttt

SEQ ID NO: 3230 - DNA, 15 bp, Homo sapiens
agagagtagattttt

SEQ ID NO: 3231 - DNA, 15 bp, Homo sapiens
gagagtagatttttt

SEQ ID NO: 3232 - DNA, 15 bp, Homo sapiens
agagtagattttttt

SEQ ID NO: 3233 - DNA, 15 bp, Homo sapiens
gagtagatttttttt

SEQ ID NO: 3234 - DNA, 15 bp, Homo sapiens
agtagattttttttt

SEQ ID NO: 3235 - DNA, 15 bp, Homo sapiens
gtagatttttttttt

SEQ ID NO: 3236 - DNA, 15 bp, Homo sapiens
tagattttttttttt

SEQ ID NO: 3237 - DNA, 15 bp, Homo sapiens
agatttttttttttt

SEQ ID NO: 3238 - DNA, 15 bp, Homo sapiens
gattttttttttttt

SEQ ID NO: 3239 - DNA, 15 bp, Homo sapiens
atttttttttttttt

SEQ ID NO: 3240 - DNA, 15 bp, Homo sapiens
tttttttttttttta

SEQ ID NO: 3241 - DNA, 15 bp, Homo sapiens
tttttttttttttag

SEQ ID NO: 3242 - DNA, 15 bp, Homo sapiens
ttttttttttttaga

SEQ ID NO: 3243 - DNA, 15 bp, Homo sapiens
tttttttttttagat

SEQ ID NO: 3244 - DNA, 15 bp, Homo sapiens
ttttttttttagatg

SEQ ID NO: 3245 - DNA, 15 bp, Homo sapiens
tttttttttagatgg

SEQ ID NO: 3246 - DNA, 15 bp, Homo sapiens
ttttttttagatgga

SEQ ID NO: 3247 - DNA, 15 bp, Homo sapiens
tttttttagatggag

SEQ ID NO: 3248 - DNA, 15 bp, Homo sapiens
ttttttagatggagt

SEQ ID NO: 3249 - DNA, 15 bp, Homo sapiens
tttttagatggagtt

SEQ ID NO: 3250 - DNA, 15 bp, Homo sapiens
ttttagatggagttt

SEQ ID NO: 3251 - DNA, 15 bp, Homo sapiens
tttagatggagtttt

SEQ ID NO: 3252 - DNA, 15 bp, Homo sapiens
ttagatggagttttg

SEQ ID NO: 3253 - DNA, 15 bp, Homo sapiens
tagatggagttttgc

SEQ ID NO: 3254 - DNA, 15 bp, Homo sapiens
agatggagttttgct

SEQ ID NO: 3255 - DNA, 15 bp, Homo sapiens
gatggagttttgctc

SEQ ID NO: 3256 - DNA, 15 bp, Homo sapiens
atggagttttgctct

SEQ ID NO: 3257 - DNA, 15 bp, Homo sapiens
tggagttttgctctt

SEQ ID NO: 3258 - DNA, 15 bp, Homo sapiens
ggagttttgctcttg

SEQ ID NO: 3259 - DNA, 15 bp, Homo sapiens
gagttttgctcttgt

SEQ ID NO: 3260 - DNA, 15 bp, Homo sapiens
agttttgctcttgtt

SEQ ID NO: 3261 - DNA, 15 bp, Homo sapiens
gttttgctcttgttg

SEQ ID NO: 3262 - DNA, 15 bp, Homo sapiens
ttttgctcttgttgt

SEQ ID NO: 3263 - DNA, 15 bp, Homo sapiens
tttgctcttgttgtc

SEQ ID NO: 3264 - DNA, 15 bp, Homo sapiens
ttgctcttgttgtcc

SEQ ID NO: 3265 - DNA, 15 bp, Homo sapiens
tgctcttgttgtcca

SEQ ID NO: 3266 - DNA, 15 bp, Homo sapiens
gctcttgttgtccag

SEQ ID NO: 3267 - DNA, 15 bp, Homo sapiens
ctcttgttgtccagg

SEQ ID NO: 3268 - DNA, 15 bp, Homo sapiens
tcttgttgtccaggc

SEQ ID NO: 3269 - DNA, 15 bp, Homo sapiens
cttgttgtccaggct

SEQ ID NO: 3270 - DNA, 15 bp, Homo sapiens
ttgttgtccaggctg

SEQ ID NO: 3271 - DNA, 15 bp, Homo sapiens
tgttgtccaggctgg

SEQ ID NO: 3272 - DNA, 15 bp, Homo sapiens
gttgtccaggctgga

SEQ ID NO: 3273 - DNA, 15 bp, Homo sapiens
ttgtccaggctggag

SEQ ID NO: 3274 - DNA, 15 bp, Homo sapiens
tgtccaggctggagt

SEQ ID NO: 3275 - DNA, 15 bp, Homo sapiens
gtccaggctggagtg

SEQ ID NO: 3276 - DNA, 15 bp, Homo sapiens
tccaggctggagtgc

SEQ ID NO: 3277 - DNA, 15 bp, Homo sapiens
ggagtgcaatggcaa

SEQ ID NO: 3278 - DNA, 15 bp, Homo sapiens
gagtgcaatggcaag

SEQ ID NO: 3279 - DNA, 15 bp, Homo sapiens
agtgcaatggcaaga

SEQ ID NO: 3280 - DNA, 15 bp, Homo sapiens
gtgcaatggcaagat

SEQ ID NO: 3281 - DNA, 15 bp, Homo sapiens
tgcaatggcaagatc

SEQ ID NO: 3282 - DNA, 15 bp, Homo sapiens
gcaatggcaagatct

SEQ ID NO: 3283 - DNA, 15 bp, Homo sapiens
caatggcaagatctt

SEQ ID NO: 3284 - DNA, 15 bp, Homo sapiens
aatggcaagatcttg

SEQ ID NO: 3285 - DNA, 15 bp, Homo sapiens
atggcaagatcttgg

SEQ ID NO: 3286 - DNA, 15 bp, Homo sapiens
tggcaagatcttggc

SEQ ID NO: 3287 - DNA, 15 bp, Homo sapiens
ggcaagatcttggct

SEQ ID NO: 3288 - DNA, 15 bp, Homo sapiens
gcaagatcttggctc

SEQ ID NO: 3289 - DNA, 15 bp, Homo sapiens
caagatcttggctca

SEQ ID NO: 3290 - DNA, 15 bp, Homo sapiens
aagatcttggctcac

SEQ ID NO: 3291 - DNA, 15 bp, Homo sapiens
agatcttggctcact

SEQ ID NO: 3292 - DNA, 15 bp, Homo sapiens
gatcttggctcactg

SEQ ID NO: 3293 - DNA, 15 bp, Homo sapiens
atcttggctcactgc

SEQ ID NO: 3294 - DNA, 15 bp, Homo sapiens
tcttggctcactgca

SEQ ID NO: 3295 - DNA, 15 bp, Homo sapiens
cttggctcactgcaa

SEQ ID NO: 3296 - DNA, 15 bp, Homo sapiens
ttggctcactgcaac

SEQ ID NO: 3297 - DNA, 15 bp, Homo sapiens
tggctcactgcaacc

SEQ ID NO: 3298 - DNA, 15 bp, Homo sapiens
ggctcactgcaacct

SEQ ID NO: 3299 - DNA, 15 bp, Homo sapiens
gctcactgcaacctc

SEQ ID NO: 3300 - DNA, 15 bp, Homo sapiens
ctcactgcaacctcc

SEQ ID NO: 3301 - DNA, 15 bp, Homo sapiens
tcactgcaacctccg

SEQ ID NO: 3302 - DNA, 15 bp, Homo sapiens
cactgcaacctccgc

SEQ ID NO: 3303 - DNA, 15 bp, Homo sapiens
actgcaacctccgcc

SEQ ID NO: 3304 - DNA, 15 bp, Homo sapiens
ctgcaacctccgcct

SEQ ID NO: 3305 - DNA, 15 bp, Homo sapiens
tgcaacctccgcctc

SEQ ID NO: 3306 - DNA, 15 bp, Homo sapiens
gcaacctccgcctcc

SEQ ID NO: 3307 - DNA, 15 bp, Homo sapiens
caacctccgcctcct

SEQ ID NO: 3308 - DNA, 15 bp, Homo sapiens
aacctccgcctcctg

SEQ ID NO: 3309 - DNA, 15 bp, Homo sapiens
acctccgcctcctgg

SEQ ID NO: 3310 - DNA, 15 bp, Homo sapiens
cctccgcctcctggg

SEQ ID NO: 3311 - DNA, 15 bp, Homo sapiens
ctccgcctcctgggt

SEQ ID NO: 3312 - DNA, 15 bp, Homo sapiens
tccgcctcctgggtt

SEQ ID NO: 3313 - DNA, 15 bp, Homo sapiens
ccgcctcctgggttc

SEQ ID NO: 3314 - DNA, 15 bp, Homo sapiens
cgcctcctgggttca

SEQ ID NO: 3315 - DNA, 15 bp, Homo sapiens
gcctcctgggttcaa

SEQ ID NO: 3316 - DNA, 15 bp, Homo sapiens
cctcctgggttcaag

SEQ ID NO: 3317 - DNA, 15 bp, Homo sapiens
ctcctgggttcaagc

SEQ ID NO: 3318 - DNA, 15 bp, Homo sapiens
tcctgggttcaagca

SEQ ID NO: 3319 - DNA, 15 bp, Homo sapiens
cctgggttcaagcaa

SEQ ID NO: 3320 - DNA, 15 bp, Homo sapiens
ctgggttcaagcaaa

SEQ ID NO: 3321 - DNA, 15 bp, Homo sapiens
tgggttcaagcaaat

SEQ ID NO: 3322 - DNA, 15 bp, Homo sapiens
gggttcaagcaaatc

SEQ ID NO: 3323 - DNA, 15 bp, Homo sapiens
ggttcaagcaaatct

SEQ ID NO: 3324 - DNA, 15 bp, Homo sapiens
gttcaagcaaatctc

SEQ ID NO: 3325 - DNA, 15 bp, Homo sapiens
ttcaagcaaatctcc

SEQ ID NO: 3326 - DNA, 15 bp, Homo sapiens
tcaagcaaatctcct

SEQ ID NO: 3327 - DNA, 15 bp, Homo sapiens
caagcaaatctcctg

SEQ ID NO: 3328 - DNA, 15 bp, Homo sapiens
aagcaaatctcctgc

SEQ ID NO: 3329 - DNA, 15 bp, Homo sapiens
agcaaatctcctgcc

SEQ ID NO: 3330 - DNA, 15 bp, Homo sapiens
gcaaatctcctgcct

SEQ ID NO: 3331 - DNA, 15 bp, Homo sapiens
caaatctcctgcctc

SEQ ID NO: 3332 - DNA, 15 bp, Homo sapiens
aaatctcctgcctca

SEQ ID NO: 3333 - DNA, 15 bp, Homo sapiens
aatctcctgcctcag

SEQ ID NO: 3334 - DNA, 15 bp, Homo sapiens
atctcctgcctcagc

SEQ ID NO: 3335 - DNA, 15 bp, Homo sapiens
tgcctcagcctcccg

SEQ ID NO: 3336 - DNA, 15 bp, Homo sapiens
gcctcagcctcccga

SEQ ID NO: 3337 - DNA, 15 bp, Homo sapiens
cctcagcctcccgag

SEQ ID NO: 3338 - DNA, 15 bp, Homo sapiens
ctcagcctcccgagt

SEQ ID NO: 3339 - DNA, 15 bp, Homo sapiens
tcagcctcccgagta

SEQ ID NO: 3340 - DNA, 15 bp, Homo sapiens
cagcctcccgagtag

SEQ ID NO: 3341 - DNA, 15 bp, Homo sapiens
agcctcccgagtagc

SEQ ID NO: 3342 - DNA, 15 bp, Homo sapiens
gcctcccgagtagct

SEQ ID NO: 3343 - DNA, 15 bp, Homo sapiens
cctcccgagtagctg

SEQ ID NO: 3344 - DNA, 15 bp, Homo sapiens
ctcccgagtagctgg

SEQ ID NO: 3345 - DNA, 15 bp, Homo sapiens
tcccgagtagctggg

SEQ ID NO: 3346 - DNA, 15 bp, Homo sapiens
cccgagtagctggga

SEQ ID NO: 3347 - DNA, 15 bp, Homo sapiens
ccgagtagctgggat

SEQ ID NO: 3348 - DNA, 15 bp, Homo sapiens
cgagtagctgggatt

SEQ ID NO: 3349 - DNA, 15 bp, Homo sapiens
gagtagctgggatta

SEQ ID NO: 3350 - DNA, 15 bp, Homo sapiens
agtagctgggattac

SEQ ID NO: 3351 - DNA, 15 bp, Homo sapiens
gtagctgggattaca

SEQ ID NO: 3352 - DNA, 15 bp, Homo sapiens
tagctgggattacag

SEQ ID NO: 3353 - DNA, 15 bp, Homo sapiens
agctgggattacagg

SEQ ID NO: 3354 - DNA, 15 bp, Homo sapiens
gctgggattacaggc

SEQ ID NO: 3355 - DNA, 15 bp, Homo sapiens
ctgggattacaggca

SEQ ID NO: 3356 - DNA, 15 bp, Homo sapiens
tgggattacaggcat

SEQ ID NO: 3357 - DNA, 15 bp, Homo sapiens
gggattacaggcatg

SEQ ID NO: 3358 - DNA, 15 bp, Homo sapiens
ggattacaggcatgc

SEQ ID NO: 3359 - DNA, 15 bp, Homo sapiens
gattacaggcatgcg

SEQ ID NO: 3360 - DNA, 15 bp, Homo sapiens
attacaggcatgcga

SEQ ID NO: 3361 - DNA, 15 bp, Homo sapiens
ttacaggcatgcgac

SEQ ID NO: 3362 - DNA, 15 bp, Homo sapiens
tacaggcatgcgaca

SEQ ID NO: 3363 - DNA, 15 bp, Homo sapiens
acaggcatgcgacac

SEQ ID NO: 3364 - DNA, 15 bp, Homo sapiens
caggcatgcgacacc

SEQ ID NO: 3365 - DNA, 15 bp, Homo sapiens
aggcatgcgacacca

SEQ ID NO: 3366 - DNA, 15 bp, Homo sapiens
ggcatgcgacaccat

SEQ ID NO: 3367 - DNA, 15 bp, Homo sapiens
gcatgcgacaccatg

SEQ ID NO: 3368 - DNA, 15 bp, Homo sapiens
catgcgacaccatgc

SEQ ID NO: 3369 - DNA, 15 bp, Homo sapiens
atgcgacaccatgcc

SEQ ID NO: 3370 - DNA, 15 bp, Homo sapiens
tgcgacaccatgccc

SEQ ID NO: 3371 - DNA, 15 bp, Homo sapiens
gcgacaccatgccca

SEQ ID NO: 3372 - DNA, 15 bp, Homo sapiens
cgacaccatgcccag

SEQ ID NO: 3373 - DNA, 15 bp, Homo sapiens
gacaccatgcccagc

SEQ ID NO: 3374 - DNA, 15 bp, Homo sapiens
acaccatgcccagct

SEQ ID NO: 3375 - DNA, 15 bp, Homo sapiens
caccatgcccagcta

SEQ ID NO: 3376 - DNA, 15 bp, Homo sapiens
accatgcccagctaa

SEQ ID NO: 3377 - DNA, 15 bp, Homo sapiens
ccatgcccagctaat

SEQ ID NO: 3378 - DNA, 15 bp, Homo sapiens
catgcccagctaatt

SEQ ID NO: 3379 - DNA, 15 bp, Homo sapiens
atgcccagctaattt

SEQ ID NO: 3380 - DNA, 15 bp, Homo sapiens
tgcccagctaatttt

SEQ ID NO: 3381 - DNA, 15 bp, Homo sapiens
gcccagctaattttg

SEQ ID NO: 3382 - DNA, 15 bp, Homo sapiens
cccagctaattttgt

SEQ ID NO: 3383 - DNA, 15 bp, Homo sapiens
ccagctaattttgta

SEQ ID NO: 3384 - DNA, 15 bp, Homo sapiens
cagctaattttgtat

SEQ ID NO: 3385 - DNA, 15 bp, Homo sapiens
agctaattttgtatt

SEQ ID NO: 3386 - DNA, 15 bp, Homo sapiens
gctaattttgtattt

SEQ ID NO: 3387 - DNA, 15 bp, Homo sapiens
ctaattttgtatttt

SEQ ID NO: 3388 - DNA, 15 bp, Homo sapiens
taattttgtattttt

SEQ ID NO: 3389 - DNA, 15 bp, Homo sapiens
aattttgtattttta

SEQ ID NO: 3390 - DNA, 15 bp, Homo sapiens
attttgtatttttag

SEQ ID NO: 3391 - DNA, 15 bp, Homo sapiens
ttttgtatttttagt

SEQ ID NO: 3392 - DNA, 15 bp, Homo sapiens
tttgtatttttagta

SEQ ID NO: 3393 - DNA, 15 bp, Homo sapiens
ttgtatttttagtag

SEQ ID NO: 3394 - DNA, 15 bp, Homo sapiens
tgtatttttagtaga

SEQ ID NO: 3395 - DNA, 15 bp, Homo sapiens
gtatttttagtagag

SEQ ID NO: 3396 - DNA, 15 bp, Homo sapiens
tatttttagtagaga

SEQ ID NO: 3397 - DNA, 15 bp, Homo sapiens
atttttagtagagac

SEQ ID NO: 3398 - DNA, 15 bp, Homo sapiens
tttttagtagagacg

SEQ ID NO: 3399 - DNA, 15 bp, Homo sapiens
ttttagtagagacgg

SEQ ID NO: 3400 - DNA, 15 bp, Homo sapiens
tttagtagagacggg

SEQ ID NO: 3401 - DNA, 15 bp, Homo sapiens
ttagtagagacgggg

SEQ ID NO: 3402 - DNA, 15 bp, Homo sapiens
tagtagagacggggt

SEQ ID NO: 3403 - DNA, 15 bp, Homo sapiens
agtagagacggggtt

SEQ ID NO: 3404 - DNA, 15 bp, Homo sapiens
gtagagacggggttt

SEQ ID NO: 3405 - DNA, 15 bp, Homo sapiens
tagagacggggtttc

SEQ ID NO: 3406 - DNA, 15 bp, Homo sapiens
agagacggggtttct

SEQ ID NO: 3407 - DNA, 15 bp, Homo sapiens
gagacggggtttctc

SEQ ID NO: 3408 - DNA, 15 bp, Homo sapiens
agacggggtttctcc

SEQ ID NO: 3409 - DNA, 15 bp, Homo sapiens
gacggggtttctcca

SEQ ID NO: 3410 - DNA, 15 bp, Homo sapiens
acggggtttctccat

SEQ ID NO: 3411 - DNA, 15 bp, Homo sapiens
cggggtttctccatg

SEQ ID NO: 3412 - DNA, 15 bp, Homo sapiens
ggggtttctccatgt

SEQ ID NO: 3413 - DNA, 15 bp, Homo sapiens
gggtttctccatgtt

SEQ ID NO: 3414 - DNA, 15 bp, Homo sapiens
ggtttctccatgttg

SEQ ID NO: 3415 - DNA, 15 bp, Homo sapiens
gtttctccatgttgg

SEQ ID NO: 3416 - DNA, 15 bp, Homo sapiens
tttctccatgttggt

SEQ ID NO: 3417 - DNA, 15 bp, Homo sapiens
ttctccatgttggtc

SEQ ID NO: 3418 - DNA, 15 bp, Homo sapiens
tctccatgttggtca

SEQ ID NO: 3419 - DNA, 15 bp, Homo sapiens
ctccatgttggtcag

SEQ ID NO: 3420 - DNA, 15 bp, Homo sapiens
tccatgttggtcagg

SEQ ID NO: 3421 - DNA, 15 bp, Homo sapiens
tggtcaggctgatcc

SEQ ID NO: 3422 - DNA, 15 bp, Homo sapiens
ggtcaggctgatccg

SEQ ID NO: 3423 - DNA, 15 bp, Homo sapiens
gtcaggctgatccgc

SEQ ID NO: 3424 - DNA, 15 bp, Homo sapiens
tcaggctgatccgcc

SEQ ID NO: 3425 - DNA, 15 bp, Homo sapiens
caggctgatccgcct

SEQ ID NO: 3426 - DNA, 15 bp, Homo sapiens
aggctgatccgcctg

SEQ ID NO: 3427 - DNA, 15 bp, Homo sapiens
ggctgatccgcctgc

SEQ ID NO: 3428 - DNA, 15 bp, Homo sapiens
gctgatccgcctgcc

SEQ ID NO: 3429 - DNA, 15 bp, Homo sapiens
ctgatccgcctgcct

SEQ ID NO: 3430 - DNA, 15 bp, Homo sapiens
tgatccgcctgcctc

SEQ ID NO: 3431 - DNA, 15 bp, Homo sapiens
gatccgcctgcctcg

SEQ ID NO: 3432 - DNA, 15 bp, Homo sapiens
atccgcctgcctcgg

SEQ ID NO: 3433 - DNA, 15 bp, Homo sapiens
tccgcctgcctcggc

SEQ ID NO: 3434 - DNA, 15 bp, Homo sapiens
ccgcctgcctcggcc

SEQ ID NO: 3435 - DNA, 15 bp, Homo sapiens
cgcctgcctcggcca

SEQ ID NO: 3436 - DNA, 15 bp, Homo sapiens
gcctgcctcggccac

SEQ ID NO: 3437 - DNA, 15 bp, Homo sapiens
cctgcctcggccacc

SEQ ID NO: 3438 - DNA, 15 bp, Homo sapiens
ctgcctcggccaccc

SEQ ID NO: 3439 - DNA, 15 bp, Homo sapiens
tgcctcggccaccca

SEQ ID NO: 3440 - DNA, 15 bp, Homo sapiens
gcctcggccacccaa

SEQ ID NO: 3441 - DNA, 15 bp, Homo sapiens
cctcggccacccaaa

SEQ ID NO: 3442 - DNA, 15 bp, Homo sapiens
ctcggccacccaaag

SEQ ID NO: 3443 - DNA, 15 bp, Homo sapiens
tcggccacccaaagg

SEQ ID NO: 3444 - DNA, 15 bp, Homo sapiens
cggccacccaaaggg

SEQ ID NO: 3445 - DNA, 15 bp, Homo sapiens
ggccacccaaagggc

SEQ ID NO: 3446 - DNA, 15 bp, Homo sapiens
gccacccaaagggct

SEQ ID NO: 3447 - DNA, 15 bp, Homo sapiens
ccacccaaagggctg

SEQ ID NO: 3448 - DNA, 15 bp, Homo sapiens
cacccaaagggctgg

SEQ ID NO: 3449 - DNA, 15 bp, Homo sapiens
acccaaagggctggg

SEQ ID NO: 3450 - DNA, 15 bp, Homo sapiens
cccaaagggctggga

SEQ ID NO: 3451 - DNA, 15 bp, Homo sapiens
ccaaagggctgggat

SEQ ID NO: 3452 - DNA, 15 bp, Homo sapiens
caaagggctgggatt

SEQ ID NO: 3453 - DNA, 15 bp, Homo sapiens
aaagggctgggatta

SEQ ID NO: 3454 - DNA, 15 bp, Homo sapiens
aagggctgggattac

SEQ ID NO: 3455 - DNA, 15 bp, Homo sapiens
agggctgggattaca

SEQ ID NO: 3456 - DNA, 15 bp, Homo sapiens
gggctgggattacag

SEQ ID NO: 3457 - DNA, 15 bp, Homo sapiens
ggctgggattacagg

SEQ ID NO: 3458 - DNA, 15 bp, Homo sapiens
ctgggattacaggcg

SEQ ID NO: 3459 - DNA, 15 bp, Homo sapiens
tgggattacaggcgt

SEQ ID NO: 3460 - DNA, 15 bp, Homo sapiens
gggattacaggcgtg

SEQ ID NO: 3461 - DNA, 15 bp, Homo sapiens
ggattacaggcgtga

SEQ ID NO: 3462 - DNA, 15 bp, Homo sapiens
gattacaggcgtgag

SEQ ID NO: 3463 - DNA, 15 bp, Homo sapiens
attacaggcgtgagc

SEQ ID NO: 3464 - DNA, 15 bp, Homo sapiens
ttacaggcgtgagcc

SEQ ID NO: 3465 - DNA, 15 bp, Homo sapiens
tacaggcgtgagcca

SEQ ID NO: 3466 - DNA, 15 bp, Homo sapiens
aggcgtgagccaccg

SEQ ID NO: 3467 - DNA, 15 bp, Homo sapiens
ggcgtgagccaccgg

SEQ ID NO: 3468 - DNA, 15 bp, Homo sapiens
gcgtgagccaccggg

SEQ ID NO: 3469 - DNA, 15 bp, Homo sapiens
cgtgagccaccgggc

SEQ ID NO: 3470 - DNA, 15 bp, Homo sapiens
gtgagccaccgggcc

SEQ ID NO: 3471 - DNA, 15 bp, Homo sapiens
tgagccaccgggcct

SEQ ID NO: 3472 - DNA, 15 bp, Homo sapiens
gagccaccgggcctg

SEQ ID NO: 3473 - DNA, 15 bp, Homo sapiens
agccaccgggcctgg

SEQ ID NO: 3474 - DNA, 15 bp, Homo sapiens
gccaccgggcctggc

SEQ ID NO: 3475 - DNA, 15 bp, Homo sapiens
ccaccgggcctggcc

SEQ ID NO: 3476 - DNA, 15 bp, Homo sapiens
caccgggcctggccg

SEQ ID NO: 3477 - DNA, 15 bp, Homo sapiens
accgggcctggccga

SEQ ID NO: 3478 - DNA, 15 bp, Homo sapiens
ccgggcctggccgag

SEQ ID NO: 3479 - DNA, 15 bp, Homo sapiens
cgggcctggccgaga

SEQ ID NO: 3480 - DNA, 15 bp, Homo sapiens
gggcctggccgagag

SEQ ID NO: 3481 - DNA, 15 bp, Homo sapiens
ggcctggccgagagt

SEQ ID NO: 3482 - DNA, 15 bp, Homo sapiens
gcctggccgagagta

SEQ ID NO: 3483 - DNA, 15 bp, Homo sapiens
cctggccgagagtag

SEQ ID NO: 3484 - DNA, 15 bp, Homo sapiens
ctggccgagagtaga

SEQ ID NO: 3485 - DNA, 15 bp, Homo sapiens
tggccgagagtagat

SEQ ID NO: 3486 - DNA, 15 bp, Homo sapiens
ggccgagagtagatc

SEQ ID NO: 3487 - DNA, 15 bp, Homo sapiens
gccgagagtagatct

SEQ ID NO: 3488 - DNA, 15 bp, Homo sapiens
ccgagagtagatctt

SEQ ID NO: 3489 - DNA, 15 bp, Homo sapiens
cgagagtagatctta

SEQ ID NO: 3490 - DNA, 15 bp, Homo sapiens
gagagtagatcttaa

SEQ ID NO: 3491 - DNA, 15 bp, Homo sapiens
agagtagatcttaaa

SEQ ID NO: 3492 - DNA, 15 bp, Homo sapiens
gagtagatcttaaaa

SEQ ID NO: 3493 - DNA, 15 bp, Homo sapiens
agtagatcttaaaag

SEQ ID NO: 3494 - DNA, 15 bp, Homo sapiens
gtagatcttaaaagc

SEQ ID NO: 3495 - DNA, 15 bp, Homo sapiens
tagatcttaaaagca

SEQ ID NO: 3496 - DNA, 15 bp, Homo sapiens
agatcttaaaagcat

SEQ ID NO: 3497 - DNA, 15 bp, Homo sapiens
gatcttaaaagcatt

SEQ ID NO: 3498 - DNA, 15 bp, Homo sapiens
atcttaaaagcattt

SEQ ID NO: 3499 - DNA, 15 bp, Homo sapiens
tcttaaaagcattta

SEQ ID NO: 3500 - DNA, 15 bp, Homo sapiens
cttaaaagcatttac

SEQ ID NO: 3501 - DNA, 15 bp, Homo sapiens
ttaaaagcatttacc

SEQ ID NO: 3502 - DNA, 15 bp, Homo sapiens
taaaagcatttacca

SEQ ID NO: 3503 - DNA, 15 bp, Homo sapiens
aaaagcatttaccac

SEQ ID NO: 3504 - DNA, 15 bp, Homo sapiens
aaagcatttaccaca

SEQ ID NO: 3505 - DNA, 15 bp, Homo sapiens
aagcatttaccacaa

SEQ ID NO: 3506 - DNA, 15 bp, Homo sapiens
agcatttaccacaag

SEQ ID NO: 3507 - DNA, 15 bp, Homo sapiens
gcatttaccacaaga

SEQ ID NO: 3508 - DNA, 15 bp, Homo sapiens
catttaccacaagaa

SEQ ID NO: 3509 - DNA, 15 bp, Homo sapiens
atttaccacaagaaa

SEQ ID NO: 3510 - DNA, 15 bp, Homo sapiens
tttaccacaagaaaa

SEQ ID NO: 3511 - DNA, 15 bp, Homo sapiens
ttaccacaagaaaaa

SEQ ID NO: 3512 - DNA, 15 bp, Homo sapiens
taccacaagaaaaag

SEQ ID NO: 3513 - DNA, 15 bp, Homo sapiens
accacaagaaaaagg

SEQ ID NO: 3514 - DNA, 15 bp, Homo sapiens
ccacaagaaaaaggt

SEQ ID NO: 3515 - DNA, 15 bp, Homo sapiens
cacaagaaaaaggta

SEQ ID NO: 3516 - DNA, 15 bp, Homo sapiens
acaagaaaaaggtaa

SEQ ID NO: 3517 - DNA, 15 bp, Homo sapiens
caagaaaaaggtaac

SEQ ID NO: 3518 - DNA, 15 bp, Homo sapiens
aagaaaaaggtaact

SEQ ID NO: 3519 - DNA, 15 bp, Homo sapiens
agaaaaaggtaacta

SEQ ID NO: 3520 - DNA, 15 bp, Homo sapiens
gaaaaaggtaactat

SEQ ID NO: 3521 - DNA, 15 bp, Homo sapiens
aaaaaggtaactatg

SEQ ID NO: 3522 - DNA, 15 bp, Homo sapiens
aaaaggtaactatgt

SEQ ID NO: 3523 - DNA, 15 bp, Homo sapiens
aaaggtaactatgtg

SEQ ID NO: 3524 - DNA, 15 bp, Homo sapiens
aaggtaactatgtga

SEQ ID NO: 3525 - DNA, 15 bp, Homo sapiens
aggtaactatgtgag

SEQ ID NO: 3526 - DNA, 15 bp, Homo sapiens
ggtaactatgtgaga

SEQ ID NO: 3527 - DNA, 15 bp, Homo sapiens
gtaactatgtgagat

SEQ ID NO: 3528 - DNA, 15 bp, Homo sapiens
taactatgtgagata

SEQ ID NO: 3529 - DNA, 15 bp, Homo sapiens
aactatgtgagataa

SEQ ID NO: 3530 - DNA, 15 bp, Homo sapiens
actatgtgagataat

SEQ ID NO: 3531 - DNA, 15 bp, Homo sapiens
ctatgtgagataatg

SEQ ID NO: 3532 - DNA, 15 bp, Homo sapiens
tatgtgagataatgg

SEQ ID NO: 3533 - DNA, 15 bp, Homo sapiens
atgtgagataatggg

SEQ ID NO: 3534 - DNA, 15 bp, Homo sapiens
tgtgagataatgggt

SEQ ID NO: 3535 - DNA, 15 bp, Homo sapiens
gtgagataatgggta

SEQ ID NO: 3536 - DNA, 15 bp, Homo sapiens
tgagataatgggtat

SEQ ID NO: 3537 - DNA, 15 bp, Homo sapiens
gagataatgggtatg

SEQ ID NO: 3538 - DNA, 15 bp, Homo sapiens
agataatgggtatgt

SEQ ID NO: 3539 - DNA, 15 bp, Homo sapiens
gataatgggtatgtt

SEQ ID NO: 3540 - DNA, 15 bp, Homo sapiens
ataatgggtatgtta

SEQ ID NO: 3541 - DNA, 15 bp, Homo sapiens
taatgggtatgttaa

SEQ ID NO: 3542 - DNA, 15 bp, Homo sapiens
aatgggtatgttaat

SEQ ID NO: 3543 - DNA, 15 bp, Homo sapiens
atgggtatgttaatt

SEQ ID NO: 3544 - DNA, 15 bp, Homo sapiens
tgggtatgttaatta

SEQ ID NO: 3545 - DNA, 15 bp, Homo sapiens
gggtatgttaattag

SEQ ID NO: 3546 - DNA, 15 bp, Homo sapiens
ggtatgttaattagc

SEQ ID NO: 3547 - DNA, 15 bp, Homo sapiens
gtatgttaattagct

SEQ ID NO: 3548 - DNA, 15 bp, Homo sapiens
tatgttaattagctt

SEQ ID NO: 3549 - DNA, 15 bp, Homo sapiens
atgttaattagcttg

SEQ ID NO: 3550 - DNA, 15 bp, Homo sapiens
tgttaattagcttga

SEQ ID NO: 3551 - DNA, 15 bp, Homo sapiens
gttaattagcttgat

SEQ ID NO: 3552 - DNA, 15 bp, Homo sapiens
ttaattagcttgatt

SEQ ID NO: 3553 - DNA, 15 bp, Homo sapiens
taattagcttgattg

SEQ ID NO: 3554 - DNA, 15 bp, Homo sapiens
aattagcttgattgt

SEQ ID NO: 3555 - DNA, 15 bp, Homo sapiens
attagcttgattgtg

SEQ ID NO: 3556 - DNA, 15 bp, Homo sapiens
ttagcttgattgtgg

SEQ ID NO: 3557 - DNA, 15 bp, Homo sapiens
tagcttgattgtggt

SEQ ID NO: 3558 - DNA, 15 bp, Homo sapiens
agcttgattgtggta

SEQ ID NO: 3559 - DNA, 15 bp, Homo sapiens
gcttgattgtggtaa

SEQ ID NO: 3560 - DNA, 15 bp, Homo sapiens
cttgattgtggtaat

SEQ ID NO: 3561 - DNA, 15 bp, Homo sapiens
ttgattgtggtaatc

SEQ ID NO: 3562 - DNA, 15 bp, Homo sapiens
tgattgtggtaatca

SEQ ID NO: 3563 - DNA, 15 bp, Homo sapiens
gattgtggtaatcat

SEQ ID NO: 3564 - DNA, 15 bp, Homo sapiens
attgtggtaatcatt

SEQ ID NO: 3565 - DNA, 15 bp, Homo sapiens
ttgtggtaatcattt

SEQ ID NO: 3566 - DNA, 15 bp, Homo sapiens
tgtggtaatcatttc

SEQ ID NO: 3567 - DNA, 15 bp, Homo sapiens
gtggtaatcatttca

SEQ ID NO: 3568 - DNA, 15 bp, Homo sapiens
tggtaatcatttcac

SEQ ID NO: 3569 - DNA, 15 bp, Homo sapiens
ggtaatcatttcaca

SEQ ID NO: 3570 - DNA, 15 bp, Homo sapiens
gtaatcatttcacaa

SEQ ID NO: 3571 - DNA, 15 bp, Homo sapiens
taatcatttcacaag

SEQ ID NO: 3572 - DNA, 15 bp, Homo sapiens
aatcatttcacaagg

SEQ ID NO: 3573 - DNA, 15 bp, Homo sapiens
atcatttcacaaggt

SEQ ID NO: 3574 - DNA, 15 bp, Homo sapiens
tcatttcacaaggta

SEQ ID NO: 3575 - DNA, 15 bp, Homo sapiens
catttcacaaggtat

SEQ ID NO: 3576 - DNA, 15 bp, Homo sapiens
atttcacaaggtata

SEQ ID NO: 3577 - DNA, 15 bp, Homo sapiens
tttcacaaggtatac

SEQ ID NO: 3578 - DNA, 15 bp, Homo sapiens
ttcacaaggtataca

SEQ ID NO: 3579 - DNA, 15 bp, Homo sapiens
tcacaaggtatacat

SEQ ID NO: 3580 - DNA, 15 bp, Homo sapiens
cacaaggtatacata

SEQ ID NO: 3581 - DNA, 15 bp, Homo sapiens
acaaggtatacatat

SEQ ID NO: 3582 - DNA, 15 bp, Homo sapiens
caaggtatacatata

SEQ ID NO: 3583 - DNA, 15 bp, Homo sapiens
aaggtatacatatat

SEQ ID NO: 3584 - DNA, 15 bp, Homo sapiens
aggtatacatatatt

SEQ ID NO: 3585 - DNA, 15 bp, Homo sapiens
ggtatacatatatta

SEQ ID NO: 3586 - DNA, 15 bp, Homo sapiens
gtatacatatattaa

SEQ ID NO: 3587 - DNA, 15 bp, Homo sapiens
tatacatatattaaa

SEQ ID NO: 3588 - DNA, 15 bp, Homo sapiens
atacatatattaaaa

SEQ ID NO: 3589 - DNA, 15 bp, Homo sapiens
tacatatattaaaac

SEQ ID NO: 3590 - DNA, 15 bp, Homo sapiens
acatatattaaaaca

SEQ ID NO: 3591 - DNA, 15 bp, Homo sapiens
catatattaaaacat

SEQ ID NO: 3592 - DNA, 15 bp, Homo sapiens
atatattaaaacatc

SEQ ID NO: 3593 - DNA, 15 bp, Homo sapiens
tatattaaaacatca

SEQ ID NO: 3594 - DNA, 15 bp, Homo sapiens
atattaaaacatcat

SEQ ID NO: 3595 - DNA, 15 bp, Homo sapiens
tattaaaacatcatg

SEQ ID NO: 3596 - DNA, 15 bp, Homo sapiens
attaaaacatcatgt

SEQ ID NO: 3597 - DNA, 15 bp, Homo sapiens
ttaaaacatcatgtt

SEQ ID NO: 3598 - DNA, 15 bp, Homo sapiens
taaaacatcatgttg

SEQ ID NO: 3599 - DNA, 15 bp, Homo sapiens
aaaacatcatgttgt

SEQ ID NO: 3600 - DNA, 15 bp, Homo sapiens
aaacatcatgttgta

SEQ ID NO: 3601 - DNA, 15 bp, Homo sapiens
aacatcatgttgtac

SEQ ID NO: 3602 - DNA, 15 bp, Homo sapiens
acatcatgttgtaca

SEQ ID NO: 3603 - DNA, 15 bp, Homo sapiens
catcatgttgtacac

SEQ ID NO: 3604 - DNA, 15 bp, Homo sapiens
atcatgttgtacacc

SEQ ID NO: 3605 - DNA, 15 bp, Homo sapiens
tcatgttgtacacct

SEQ ID NO: 3606 - DNA, 15 bp, Homo sapiens
catgttgtacacctt

SEQ ID NO: 3607 - DNA, 15 bp, Homo sapiens
atgttgtacacctta

SEQ ID NO: 3608 - DNA, 15 bp, Homo sapiens
tgttgtacaccttaa

SEQ ID NO: 3609 - DNA, 15 bp, Homo sapiens
gttgtacaccttaaa

SEQ ID NO: 3610 - DNA, 15 bp, Homo sapiens
ttgtacaccttaaat

SEQ ID NO: 3611 - DNA, 15 bp, Homo sapiens
tgtacaccttaaata

SEQ ID NO: 3612 - DNA, 15 bp, Homo sapiens
gtacaccttaaatat

SEQ ID NO: 3613 - DNA, 15 bp, Homo sapiens
tacaccttaaatata

SEQ ID NO: 3614 - DNA, 15 bp, Homo sapiens
acaccttaaatatat

SEQ ID NO: 3615 - DNA, 15 bp, Homo sapiens
caccttaaatatata

SEQ ID NO: 3616 - DNA, 15 bp, Homo sapiens
accttaaatatatac

SEQ ID NO: 3617 - DNA, 15 bp, Homo sapiens
ccttaaatatataca

SEQ ID NO: 3618 - DNA, 15 bp, Homo sapiens
cttaaatatatacaa

SEQ ID NO: 3619 - DNA, 15 bp, Homo sapiens
ttaaatatatacaat

SEQ ID NO: 3620 - DNA, 15 bp, Homo sapiens
taaatatatacaatt

SEQ ID NO: 3621 - DNA, 15 bp, Homo sapiens
aaatatatacaattt

SEQ ID NO: 3622 - DNA, 15 bp, Homo sapiens
aatatatacaatttt

SEQ ID NO: 3623 - DNA, 15 bp, Homo sapiens
atatatacaattttt

SEQ ID NO: 3624 - DNA, 15 bp, Homo sapiens
tatatacaattttta

SEQ ID NO: 3625 - DNA, 15 bp, Homo sapiens
atatacaatttttat

SEQ ID NO: 3626 - DNA, 15 bp, Homo sapiens
tatacaatttttatt

SEQ ID NO: 3627 - DNA, 15 bp, Homo sapiens
atacaatttttattt

SEQ ID NO: 3628 - DNA, 15 bp, Homo sapiens
tacaatttttatttg

SEQ ID NO: 3629 - DNA, 15 bp, Homo sapiens
acaatttttatttgt

SEQ ID NO: 3630 - DNA, 15 bp, Homo sapiens
caatttttatttgtg

SEQ ID NO: 3631 - DNA, 15 bp, Homo sapiens
aatttttatttgtga

SEQ ID NO: 3632 - DNA, 15 bp, Homo sapiens
atttttatttgtgaa

SEQ ID NO: 3633 - DNA, 15 bp, Homo sapiens
tttttatttgtgaat

SEQ ID NO: 3634 - DNA, 15 bp, Homo sapiens
ttttatttgtgaatg

SEQ ID NO: 3635 - DNA, 15 bp, Homo sapiens
tttatttgtgaatga

SEQ ID NO: 3636 - DNA, 15 bp, Homo sapiens
ttatttgtgaatgat

SEQ ID NO: 3637 - DNA, 15 bp, Homo sapiens
tatttgtgaatgata

SEQ ID NO: 3638 - DNA, 15 bp, Homo sapiens
atttgtgaatgatac

SEQ ID NO: 3639 - DNA, 15 bp, Homo sapiens
tttgtgaatgatacc

SEQ ID NO: 3640 - DNA, 15 bp, Homo sapiens
ttgtgaatgatacct

SEQ ID NO: 3641 - DNA, 15 bp, Homo sapiens
tgtgaatgatacctc

SEQ ID NO: 3642 - DNA, 15 bp, Homo sapiens
gtgaatgatacctca

SEQ ID NO: 3643 - DNA, 15 bp, Homo sapiens
tgaatgatacctcaa

SEQ ID NO: 3644 - DNA, 15 bp, Homo sapiens
gaatgatacctcaat

SEQ ID NO: 3645 - DNA, 15 bp, Homo sapiens
aatgatacctcaata

SEQ ID NO: 3646 - DNA, 15 bp, Homo sapiens
atgatacctcaataa

SEQ ID NO: 3647 - DNA, 15 bp, Homo sapiens
tgatacctcaataaa

SEQ ID NO: 3648 - DNA, 15 bp, Homo sapiens
gatacctcaataaag

SEQ ID NO: 3649 - DNA, 15 bp, Homo sapiens
atacctcaataaagt

SEQ ID NO: 3650 - DNA, 15 bp, Homo sapiens
tacctcaataaagtt

SEQ ID NO: 3651 - DNA, 15 bp, Homo sapiens
acctcaataaagttg

SEQ ID NO: 3652 - DNA, 15 bp, Homo sapiens
cctcaataaagttga

SEQ ID NO: 3653 - DNA, 15 bp, Homo sapiens
ctcaataaagttgaa

SEQ ID NO: 3654 - DNA, 15 bp, Homo sapiens
tcaataaagttgaag

SEQ ID NO: 3655 - DNA, 15 bp, Homo sapiens
caataaagttgaaga

SEQ ID NO: 3656 - DNA, 15 bp, Homo sapiens
aataaagttgaagaa

SEQ ID NO: 3657 - DNA, 15 bp, Homo sapiens
ataaagttgaagaat

SEQ ID NO: 3658 - DNA, 15 bp, Homo sapiens
taaagttgaagaata

SEQ ID NO: 3659 - DNA, 15 bp, Homo sapiens
aaagttgaagaataa

SEQ ID NO: 3660 - DNA, 15 bp, Homo sapiens
aagttgaagaataat

SEQ ID NO: 3661 - DNA, 15 bp, Homo sapiens
agttgaagaataata

SEQ ID NO: 3662 - DNA, 15 bp, Homo sapiens
gttgaagaataataa

SEQ ID NO: 3663 - DNA, 15 bp, Homo sapiens
ttgaagaataataaa

SEQ ID NO: 3664 - DNA, 15 bp, Homo sapiens
tgaagaataataaaa

SEQ ID NO: 3665 - DNA, 15 bp, Homo sapiens
gaagaataataaaaa

SEQ ID NO: 3666 - DNA, 15 bp, Homo sapiens
aagaataataaaaaa

SEQ ID NO: 3667 - DNA, 15 bp, Homo sapiens
agaataataaaaaag

SEQ ID NO: 3668 - DNA, 15 bp, Homo sapiens
gaataataaaaaaga

SEQ ID NO: 3669 - DNA, 15 bp, Homo sapiens
aataataaaaaagaa

SEQ ID NO: 3670 - DNA, 15 bp, Homo sapiens
ataataaaaaagaat

SEQ ID NO: 3671 - DNA, 15 bp, Homo sapiens
taataaaaaagaata

SEQ ID NO: 3672 - DNA, 15 bp, Homo sapiens
aataaaaaagaatag

SEQ ID NO: 3673 - DNA, 15 bp, Homo sapiens
ataaaaaagaataga

SEQ ID NO: 3674 - DNA, 15 bp, Homo sapiens
taaaaaagaatagac

SEQ ID NO: 3675 - DNA, 15 bp, Homo sapiens
aaaaaagaatagaca

SEQ ID NO: 3676 - DNA, 15 bp, Homo sapiens
aaaaagaatagacat

SEQ ID NO: 3677 - DNA, 15 bp, Homo sapiens
aaaagaatagacatc

SEQ ID NO: 3678 - DNA, 15 bp, Homo sapiens
aaagaatagacatca

SEQ ID NO: 3679 - DNA, 15 bp, Homo sapiens
aagaatagacatcac

SEQ ID NO: 3680 - DNA, 15 bp, Homo sapiens
agaatagacatcaca

SEQ ID NO: 3681 - DNA, 15 bp, Homo sapiens
gaatagacatcacat

SEQ ID NO: 3682 - DNA, 15 bp, Homo sapiens
aatagacatcacatg

SEQ ID NO: 3683 - DNA, 15 bp, Homo sapiens
atagacatcacatga

SEQ ID NO: 3684 - DNA, 15 bp, Homo sapiens
tagacatcacatgaa

SEQ ID NO: 3685 - DNA, 15 bp, Homo sapiens
agacatcacatgaat

SEQ ID NO: 3686 - DNA, 15 bp, Homo sapiens
gacatcacatgaatt

SEQ ID NO: 3687 - DNA, 15 bp, Homo sapiens
acatcacatgaatta

SEQ ID NO: 3688 - DNA, 15 bp, Homo sapiens
catcacatgaattaa

SEQ ID NO: 3689 - DNA, 15 bp, Homo sapiens
atcacatgaattaaa

SEQ ID NO: 3690 - DNA, 15 bp, Homo sapiens
tcacatgaattaaaa

SEQ ID NO: 3691 - DNA, 15 bp, Homo sapiens
cacatgaattaaaaa

SEQ ID NO: 3692 - DNA, 15 bp, Homo sapiens
acatgaattaaaaaa

SEQ ID NO: 3693 - DNA, 15 bp, Homo sapiens
catgaattaaaaaac

SEQ ID NO: 3694 - DNA, 15 bp, Homo sapiens
atgaattaaaaaact

SEQ ID NO: 3695 - DNA, 15 bp, Homo sapiens
tgaattaaaaaacta

SEQ ID NO: 3696 - DNA, 15 bp, Homo sapiens
gaattaaaaaactaa

SEQ ID NO: 3697 - DNA, 15 bp, Homo sapiens
aattaaaaaactaaa

SEQ ID NO: 3698 - DNA, 15 bp, Homo sapiens
attaaaaaactaaaa

SEQ ID NO: 3699 - DNA, 15 bp, Homo sapiens
ttaaaaaactaaaaa

SEQ ID NO: 3700 - DNA, 15 bp, Homo sapiens
taaaaaactaaaaaa

SEQ ID NO: 3701 - DNA, 15 bp, Homo sapiens
aaaaaactaaaaaat

SEQ ID NO: 3702 - DNA, 15 bp, Homo sapiens
aaaaactaaaaaata

SEQ ID NO: 3703 - DNA, 15 bp, Homo sapiens
aaaactaaaaaataa

SEQ ID NO: 3704 - DNA, 15 bp, Homo sapiens
aaactaaaaaataaa

SEQ ID NO: 3705 - DNA, 15 bp, Homo sapiens
aactaaaaaataaaa

SEQ ID NO: 3706 - DNA, 15 bp, Homo sapiens
actaaaaaataaaaa

SEQ ID NO: 3707 - DNA, 15 bp, Homo sapiens
ctaaaaaataaaaaa

SEQ ID NO: 3708 - DNA, 15 bp, Homo sapiens
taaaaaataaaaaaa

SEQ ID NO: 3709 - DNA, 15 bp, Homo sapiens
aaaaaataaaaaaat

SEQ ID NO: 3710 - DNA, 15 bp, Homo sapiens
aaaaataaaaaaatg

SEQ ID NO: 3711 - DNA, 15 bp, Homo sapiens
aaaataaaaaaatgc

SEQ ID NO: 3712 - DNA, 15 bp, Homo sapiens
aaataaaaaaatgca

SEQ ID NO: 3713 - DNA, 15 bp, Homo sapiens
aataaaaaaatgcat

SEQ ID NO: 3714 - DNA, 15 bp, Homo sapiens
ataaaaaaatgcatc

SEQ ID NO: 3715 - DNA, 15 bp, Homo sapiens
taaaaaaatgcatct

SEQ ID NO: 3716 - DNA, 15 bp, Homo sapiens
aaaaaaatgcatctt

SEQ ID NO: 3717 - DNA, 15 bp, Homo sapiens
aaaaaatgcatcttg

SEQ ID NO: 3718 - DNA, 15 bp, Homo sapiens
aaaaatgcatcttga

SEQ ID NO: 3719 - DNA, 15 bp, Homo sapiens
aaaatgcatcttgat

SEQ ID NO: 3720 - DNA, 15 bp, Homo sapiens
aaatgcatcttgatg

SEQ ID NO: 3721 - DNA, 15 bp, Homo sapiens
aatgcatcttgatga

SEQ ID NO: 3722 - DNA, 15 bp, Homo sapiens
atgcatcttgatgat

SEQ ID NO: 3723 - DNA, 15 bp, Homo sapiens
tgcatcttgatgatt

SEQ ID NO: 3724 - DNA, 15 bp, Homo sapiens
gcatcttgatgatta

SEQ ID NO: 3725 - DNA, 15 bp, Homo sapiens
catcttgatgattag

SEQ ID NO: 3726 - DNA, 15 bp, Homo sapiens
atcttgatgattaga

SEQ ID NO: 3727 - DNA, 15 bp, Homo sapiens
tcttgatgattagaa

SEQ ID NO: 3728 - DNA, 15 bp, Homo sapiens
cttgatgattagaat

SEQ ID NO: 3729 - DNA, 15 bp, Homo sapiens
ttgatgattagaatt

SEQ ID NO: 3730 - DNA, 15 bp, Homo sapiens
tgatgattagaattg

SEQ ID NO: 3731 - DNA, 15 bp, Homo sapiens
gatgattagaattgc

SEQ ID NO: 3732 - DNA, 15 bp, Homo sapiens
atgattagaattgca

SEQ ID NO: 3733 - DNA, 15 bp, Homo sapiens
tgattagaattgcat

SEQ ID NO: 3734 - DNA, 15 bp, Homo sapiens
gattagaattgcatt

SEQ ID NO: 3735 - DNA, 15 bp, Homo sapiens
attagaattgcattc

SEQ ID NO: 3736 - DNA, 15 bp, Homo sapiens
ttagaattgcattct

SEQ ID NO: 3737 - DNA, 15 bp, Homo sapiens
tagaattgcattctt

SEQ ID NO: 3738 - DNA, 15 bp, Homo sapiens
agaattgcattcttg

SEQ ID NO: 3739 - DNA, 15 bp, Homo sapiens
gaattgcattcttga

SEQ ID NO: 3740 - DNA, 15 bp, Homo sapiens
aattgcattcttgat

SEQ ID NO: 3741 - DNA, 15 bp, Homo sapiens
attgcattcttgatt

SEQ ID NO: 3742 - DNA, 15 bp, Homo sapiens
ttgcattcttgattt

SEQ ID NO: 3743 - DNA, 15 bp, Homo sapiens
tgcattcttgatttt

SEQ ID NO: 3744 - DNA, 15 bp, Homo sapiens
gcattcttgattttt

SEQ ID NO: 3745 - DNA, 15 bp, Homo sapiens
cattcttgatttttc

SEQ ID NO: 3746 - DNA, 15 bp, Homo sapiens
attcttgatttttca

SEQ ID NO: 3747 - DNA, 15 bp, Homo sapiens
ttcttgatttttcag

SEQ ID NO: 3748 - DNA, 15 bp, Homo sapiens
tcttgatttttcaga

SEQ ID NO: 3749 - DNA, 15 bp, Homo sapiens
cttgatttttcagat

SEQ ID NO: 3750 - DNA, 15 bp, Homo sapiens
ttgatttttcagata

SEQ ID NO: 3751 - DNA, 15 bp, Homo sapiens
tgatttttcagatac

SEQ ID NO: 3752 - DNA, 15 bp, Homo sapiens
gatttttcagataca

SEQ ID NO: 3753 - DNA, 15 bp, Homo sapiens
atttttcagatacaa

SEQ ID NO: 3754 - DNA, 15 bp, Homo sapiens
tttttcagatacaaa

SEQ ID NO: 3755 - DNA, 15 bp, Homo sapiens
ttttcagatacaaat

SEQ ID NO: 3756 - DNA, 15 bp, Homo sapiens
tttcagatacaaata

SEQ ID NO: 3757 - DNA, 15 bp, Homo sapiens
ttcagatacaaatat

SEQ ID NO: 3758 - DNA, 15 bp, Homo sapiens
tcagatacaaatatc

SEQ ID NO: 3759 - DNA, 15 bp, Homo sapiens
cagatacaaatatcc

SEQ ID NO: 3760 - DNA, 15 bp, Homo sapiens
agatacaaatatcca

SEQ ID NO: 3761 - DNA, 15 bp, Homo sapiens
gatacaaatatccat

SEQ ID NO: 3762 - DNA, 15 bp, Homo sapiens
atacaaatatccatt

SEQ ID NO: 3763 - DNA, 15 bp, Homo sapiens
tacaaatatccattt

SEQ ID NO: 3764 - DNA, 15 bp, Homo sapiens
acaaatatccatttg

SEQ ID NO: 3765 - DNA, 15 bp, Homo sapiens
caaatatccatttga

SEQ ID NO: 3766 - DNA, 15 bp, Homo sapiens
aaatatccatttgac

SEQ ID NO: 3767 - DNA, 15 bp, Homo sapiens
aatatccatttgact

SEQ ID NO: 3768 - DNA, 15 bp, Homo sapiens
atatccatttgactg

SEQ ID NO: 3769 - DNA, 15 bp, Homo sapiens
tatccatttgactgt

SEQ ID NO: 3770 - DNA, 15 bp, Homo sapiens
atccatttgactgtt

SEQ ID NO: 3771 - DNA, 15 bp, Homo sapiens
tccatttgactgttt

SEQ ID NO: 3772 - DNA, 15 bp, Homo sapiens
ccatttgactgttta

SEQ ID NO: 3773 - DNA, 15 bp, Homo sapiens
catttgactgtttac

SEQ ID NO: 3774 - DNA, 15 bp, Homo sapiens
atttgactgtttact

SEQ ID NO: 3775 - DNA, 15 bp, Homo sapiens
tttgactgtttactc

SEQ ID NO: 3776 - DNA, 15 bp, Homo sapiens
ttgactgtttactct

SEQ ID NO: 3777 - DNA, 15 bp, Homo sapiens
tgactgtttactctt

SEQ ID NO: 3778 - DNA, 15 bp, Homo sapiens
gactgtttactcttt

SEQ ID NO: 3779 - DNA, 15 bp, Homo sapiens
actgtttactctttt

SEQ ID NO: 3780 - DNA, 15 bp, Homo sapiens
ctgtttactcttttc

SEQ ID NO: 3781 - DNA, 15 bp, Homo sapiens
tgtttactcttttcc

SEQ ID NO: 3782 - DNA, 15 bp, Homo sapiens
gtttactcttttcca

SEQ ID NO: 3783 - DNA, 15 bp, Homo sapiens
tttactcttttccaa

SEQ ID NO: 3784 - DNA, 15 bp, Homo sapiens
ttactcttttccaaa

SEQ ID NO: 3785 - DNA, 15 bp, Homo sapiens
tactcttttccaaaa

SEQ ID NO: 3786 - DNA, 15 bp, Homo sapiens
actcttttccaaaac

SEQ ID NO: 3787 - DNA, 15 bp, Homo sapiens
ctcttttccaaaaca

SEQ ID NO: 3788 - DNA, 15 bp, Homo sapiens
tcttttccaaaacaa

SEQ ID NO: 3789 - DNA, 18 bp, Homo sapiens
gctattaccttaacccag

SEQ ID NO: 3790 - DNA, 15 bp, Homo sapiens
gctattaccttaacc

SEQ ID NO: 3791 - DNA, 15 bp, Homo sapiens
ctattaccttaaccc

SEQ ID NO: 3792 - DNA, 15 bp, Homo sapiens
tattaccttaaccca

SEQ ID NO: 3793 - DNA, 15 bp, Homo sapiens
attaccttaacccag

SEQ ID NO: 3794 - DNA, 18 bp, Homo sapiens
cctcttacctcagttaca

SEQ ID NO: 3795 - DNA, 40 bp, Homo sapiens
gctattaccttaacccagttttgctattaccttaacccag

SEQ ID NO: 3796 - DNA, 40 bp, Homo sapiens
cctcttacctcagttacattttcctcttacctcagttaca

SEQ ID NO: 3797 - DNA, 15 bp, Homo sapiens
acttttatgcccagc

SEQ ID NO: 3798 - DNA, 15 bp, Homo sapiens
ttttatgcccagccc

SEQ ID NO: 3799 - DNA, 15 bp, Homo sapiens
gtagattggccaacc

SEQ ID NO: 3800 - DNA, 15 bp, Homo sapiens
tagattggccaaccc

SEQ ID NO: 3801 - DNA, 15 bp, Homo sapiens
gattggccaacccta

SEQ ID NO: 3802 - DNA, 15 bp, Homo sapiens
attggccaaccctag

SEQ ID NO: 3803 - DNA, 15 bp, Homo sapiens
tgatgacagccgtac

SEQ ID NO: 3804 - DNA, 15 bp, Homo sapiens
cagccgtacctgtcc

SEQ ID NO: 3805 - DNA, 15 bp, Homo sapiens
ccgtacctgtccttg

SEQ ID NO: 3806 - DNA, 15 bp, Homo sapiens
cgtacctgtccttgg

SEQ ID NO: 3807 - DNA, 15 bp, Homo sapiens
ttctggcactggctt

SEQ ID NO: 3808 - DNA, 15 bp, Homo sapiens
gcactggcttaggag

SEQ ID NO: 3809 - DNA, 25 bp, Homo sapiens
gctcttctggcactggcttaggagt

SEQ ID NO: 3810 - DNA, 25 bp, Homo sapiens
tctggcactggcttaggagttggac

SEQ ID NO: 3811 - DNA, 25 bp, Homo sapiens
gcactggcttaggagttggacttca

SEQ ID NO: 3812 - DNA, 15 bp, Homo sapiens
atcgttttcccaatt

SEQ ID NO: 3813 - DNA, 15 bp, Homo sapiens
aaaactctacctcgg

SEQ ID NO: 3814 - DNA, 15 bp, Homo sapiens
acctcggttctaagc

SEQ ID NO: 3815 - DNA, 15 bp, Homo sapiens
gctctgtgcattagt

SEQ ID NO: 3816 - DNA, 15 bp, Homo sapiens
aataggaggttaact

SEQ ID NO: 3817 - DNA, 15 bp, Homo sapiens
ggtcttctacttggc

SEQ ID NO: 3818 - DNA, 15 bp, Homo sapiens
gctgcaagctatact

SEQ ID NO: 3819 - DNA, 15 bp, Homo sapiens
ggtgcaggtctattc

SEQ ID NO: 3820 - DNA, 15 bp, Homo sapiens
cctctaagtataccc

SEQ ID NO: 3821 - DNA, 15 bp, Homo sapiens
gcttgacctaggaac

SEQ ID NO: 3822 - DNA, 15 bp, Homo sapiens
aaccagaacccatag

SEQ ID NO: 3823 - DNA, 15 bp, Homo sapiens
gaaacaaaccgcaca

SEQ ID NO: 3824 - DNA, 15 bp, Homo sapiens
cgaataccacacaag

SEQ ID NO: 3825 - DNA, 15 bp, Homo sapiens
tacttgtgacctctc

SEQ ID NO: 3826 - DNA, 15 bp, Homo sapiens
ctataccccatcaag

SEQ ID NO: 3827 - DNA, 15 bp, Homo sapiens
gttggagtttaatcg

SEQ ID NO: 3828 - DNA, 15 bp, Homo sapiens
ttggagtttaatcgt

SEQ ID NO: 3829 - DNA, 15 bp, Homo sapiens
ggagtttaatcgtag

SEQ ID NO: 3830 - DNA, 15 bp, Homo sapiens
gagtttaatcgtagc

SEQ ID NO: 3831 - DNA, 15 bp, Homo sapiens
agtttaatcgtagca

SEQ ID NO: 3832 - DNA, 15 bp, Homo sapiens
gtttaatcgtagcat

SEQ ID NO: 3833 - DNA, 15 bp, Homo sapiens
ttaatcgtagcatta

SEQ ID NO: 3834 - DNA, 15 bp, Homo sapiens
taatcgtagcattac

SEQ ID NO: 3835 - DNA, 15 bp, Homo sapiens
aatcgtagcattacc

SEQ ID NO: 3836 - DNA, 15 bp, Homo sapiens
atcgtagcattaccc

SEQ ID NO: 3837 - DNA, 15 bp, Homo sapiens
cgtagcattaccctt

SEQ ID NO: 3838 - DNA, 15 bp, Homo sapiens
gtagcattacccttg

SEQ ID NO: 3839 - DNA, 15 bp, Homo sapiens
gttgaggtcttccct

SEQ ID NO: 3840 - DNA, 15 bp, Homo sapiens
ttaatgccttgtacg

SEQ ID NO: 3841 - DNA, 15 bp, Homo sapiens
taatgccttgtacgg

SEQ ID NO: 3842 - DNA, 15 bp, Homo sapiens
tgccttgtacggttc

SEQ ID NO: 3843 - DNA, 15 bp, Homo sapiens
gccttgtacggttcc

SEQ ID NO: 3844 - DNA, 15 bp, Homo sapiens
ccttgtacggttccc

SEQ ID NO: 3845 - DNA, 15 bp, Homo sapiens
cttgtacggttccct

SEQ ID NO: 3846 - DNA, 15 bp, Homo sapiens
tgtacggttcccttg

SEQ ID NO: 3847 - DNA, 15 bp, Homo sapiens
gtacggttcccttgc

SEQ ID NO: 3848 - DNA, 15 bp, Homo sapiens
caagtgctccctatc

SEQ ID NO: 3849 - DNA, 15 bp, Homo sapiens
gctccctatctgtag

SEQ ID NO: 3850 - DNA, 19 bp, Homo sapiens
gccatctattgcttacatt

SEQ ID NO: 3851 - DNA, 19 bp, Homo sapiens
ccatctattgcttacattt

SEQ ID NO: 3852 - DNA, 19 bp, Homo sapiens
catctattgcttacatttg

SEQ ID NO: 3853 - DNA, 19 bp, Homo sapiens
atctattgcttacatttgc

SEQ ID NO: 3854 - DNA, 19 bp, Homo sapiens
tctattgcttacatttgct

SEQ ID NO: 3855 - DNA, 19 bp, Homo sapiens
ctattgcttacatttgctt

SEQ ID NO: 3856 - DNA, 19 bp, Homo sapiens
tattgcttacatttgcttc

SEQ ID NO: 3857 - DNA, 19 bp, Homo sapiens
attgcttacatttgcttct

SEQ ID NO: 3858 - DNA, 19 bp, Homo sapiens
ttgcttacatttgcttctg

SEQ ID NO: 3859 - DNA, 19 bp, Homo sapiens
tgcttacatttgcttctga

SEQ ID NO: 3860 - DNA, 19 bp, Homo sapiens
gcttacatttgcttctgac

SEQ ID NO: 3861 - DNA, 19 bp, Homo sapiens
cttacatttgcttctgaca

SEQ ID NO: 3862 - DNA, 19 bp, Homo sapiens
ttacatttgcttctgacac

SEQ ID NO: 3863 - DNA, 19 bp, Homo sapiens
tacatttgcttctgacaca

SEQ ID NO: 3864 - DNA, 19 bp, Homo sapiens
acatttgcttctgacacaa

SEQ ID NO: 3865 - DNA, 19 bp, Homo sapiens
catttgcttctgacacaac

SEQ ID NO: 3866 - DNA, 19 bp, Homo sapiens
atttgcttctgacacaact

SEQ ID NO: 3867 - DNA, 19 bp, Homo sapiens
tttgcttctgacacaactg

SEQ ID NO: 3868 - DNA, 19 bp, Homo sapiens
ttgcttctgacacaactgt

SEQ ID NO: 3869 - DNA, 19 bp, Homo sapiens
tgcttctgacacaactgtg

SEQ ID NO: 3870 - DNA, 19 bp, Homo sapiens
cacaactgtgttcactagc

SEQ ID NO: 3871 - DNA, 19 bp, Homo sapiens
agggcaaagaacaggtggg

SEQ ID NO: 3872 - DNA, 19 bp, Homo sapiens
ggcaaagaacaggtgggaa

SEQ ID NO: 3873 - DNA, 19 bp, Homo sapiens
gcaaagaacaggtgggaat

SEQ ID NO: 3874 - DNA, 19 bp, Homo sapiens
agaacaggtgggaatgtat

SEQ ID NO: 3875 - DNA, 19 bp, Homo sapiens
gggaatgtatccagagaat

SEQ ID NO: 3876 - DNA, 19 bp, Homo sapiens
ggaatgtatccagagaatc

SEQ ID NO: 3877 - DNA, 19 bp, Homo sapiens
gaatgtatccagagaatca

SEQ ID NO: 3878 - DNA, 19 bp, Homo sapiens
aatgtatccagagaatcaa

SEQ ID NO: 3879 - DNA, 19 bp, Homo sapiens
atgtatccagagaatcaac

SEQ ID NO: 3880 - DNA, 19 bp, Homo sapiens
tgtatccagagaatcaaca

SEQ ID NO: 3881 - DNA, 19 bp, Homo sapiens
gtatccagagaatcaacat

SEQ ID NO: 3882 - DNA, 19 bp, Homo sapiens
tatccagagaatcaacata

SEQ ID NO: 3883 - DNA, 19 bp, Homo sapiens
atccagagaatcaacatac

SEQ ID NO: 3884 - DNA, 19 bp, Homo sapiens
tccagagaatcaacataca

SEQ ID NO: 3885 - DNA, 19 bp, Homo sapiens
agagaatcaacatacaatg

SEQ ID NO: 3886 - DNA, 19 bp, Homo sapiens
agaatcaacatacaatgag

SEQ ID NO: 3887 - DNA, 19 bp, Homo sapiens
gaatcaacatacaatgagc

SEQ ID NO: 3888 - DNA, 19 bp, Homo sapiens
aatcaacatacaatgagca

SEQ ID NO: 3889 - DNA, 19 bp, Homo sapiens
atcaacatacaatgagcaa

SEQ ID NO: 3890 - DNA, 19 bp, Homo sapiens
tcaacatacaatgagcaaa

SEQ ID NO: 3891 - DNA, 19 bp, Homo sapiens
caacatacaatgagcaaaa

SEQ ID NO: 3892 - DNA, 19 bp, Homo sapiens
aacatacaatgagcaaaag

SEQ ID NO: 3893 - DNA, 19 bp, Homo sapiens
ggaagcacccttcagcagt

SEQ ID NO: 3894 - DNA, 19 bp, Homo sapiens
gaagcacccttcagcagtt

SEQ ID NO: 3895 - DNA, 19 bp, Homo sapiens
agcacccttcagcagttcc

SEQ ID NO: 3896 - DNA, 19 bp, Homo sapiens
gcacccttcagcagttcca

SEQ ID NO: 3897 - DNA, 19 bp, Homo sapiens
cacccttcagcagttccac

SEQ ID NO: 3898 - DNA, 19 bp, Homo sapiens
acccttcagcagttccaca

SEQ ID NO: 3899 - DNA, 19 bp, Homo sapiens
cccttcagcagttccacac

SEQ ID NO: 3900 - DNA, 19 bp, Homo sapiens
ccttcagcagttccacaca

SEQ ID NO: 3901 - DNA, 19 bp, Homo sapiens
cttcagcagttccacacac

SEQ ID NO: 3902 - DNA, 19 bp, Homo sapiens
ttcagcagttccacacact

SEQ ID NO: 3903 - DNA, 19 bp, Homo sapiens
cagcagttccacacactcg

SEQ ID NO: 3904 - DNA, 19 bp, Homo sapiens
agcagttccacacactcgc

SEQ ID NO: 3905 - DNA, 19 bp, Homo sapiens
gcagttccacacactcgct

SEQ ID NO: 3906 - DNA, 19 bp, Homo sapiens
cagttccacacactcgctt

SEQ ID NO: 3907 - DNA, 19 bp, Homo sapiens
agttccacacactcgcttc

SEQ ID NO: 3908 - DNA, 19 bp, Homo sapiens
gttccacacactcgcttct

SEQ ID NO: 3909 - DNA, 19 bp, Homo sapiens
ttccacacactcgcttctg

SEQ ID NO: 3910 - DNA, 19 bp, Homo sapiens
tccacacactcgcttctgg

SEQ ID NO: 3911 - DNA, 19 bp, Homo sapiens
ccacacactcgcttctgga

SEQ ID NO: 3912 - DNA, 19 bp, Homo sapiens
acacactcgcttctggaac

SEQ ID NO: 3913 - DNA, 19 bp, Homo sapiens
cacactcgcttctggaacg

SEQ ID NO: 3914 - DNA, 19 bp, Homo sapiens
acactcgcttctggaacgt

SEQ ID NO: 3915 - DNA, 19 bp, Homo sapiens
cactcgcttctggaacgtc

SEQ ID NO: 3916 - DNA, 19 bp, Homo sapiens
actcgcttctggaacgtct

SEQ ID NO: 3917 - DNA, 570 bp, Homo sapiens
tgtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagccttcccagggtttctcctccagcatcttccacattcaccttgccccacaggcttgtgatagtagccttgtcctcctctgtgaaatgacccatggcgtctggactaggagcttattgataacctcagacgt

What is claimed is:

1. A single stranded oligonucleotide produced by a process comprising:
synthesizing a single stranded oligonucleotide that:
(a) has a sequence 5'-X-Y-Z, wherein X is any nucleotide, Y is a nucleotide sequence of 6 nucleotides in length that is not a seed sequence of a human microRNA, and Z is a nucleotide sequence of 4-9 nucleotides in length,
(b) is complementary with at least 8 consecutive nucleotides of a PRC2-associated region of a human hemoglobin gene, wherein the PRC2-associated region is a region of the hemoglobin gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the hemoglobin gene compared to a control sequencing reaction of products of a control RNA-immunoprecipitation assay that employs a control antibody; and
(c) is 11 to 16 nucleotides in length, wherein, during the synthesis, at least one nucleotide incorporated into the oligonucleotide is a nucleotide analogue.

2. The single stranded oligonucleotide of claim 1, wherein the oligonucleotide does not comprise three or more consecutive guanosine nucleotides.

3. The single stranded oligonucleotide of claim 1, wherein the oligonucleotide does not comprise four or more consecutive guanosine nucleotides.

4. The single stranded oligonucleotide of claim 1, wherein the at least one nucleotide analogue results in an increase in Tm of the oligonucleotide in a range of 1 to 5 ° C. compared with an oligonucleotide that does not have the at least one nucleotide analogue.

5. The single stranded oligonucleotide of claim 1, wherein at least one nucleotide of the oligonucleotide comprises a 2' O-methyl.

6. The single stranded oligonucleotide of claim 1, wherein each nucleotide of the oligonucleotide comprises a 2' O-methyl.

7. The single stranded oligonucleotide of claim 1, wherein the oligonucleotide comprises at least one ribonucleotide, at least one deoxyribonucleotide, or at least one bridged nucleotide.

8. The single strand oligonucleotide of claim 7, wherein the bridged nucleotide is a LNA nucleotide, a cEt nucleotide or a ENA modified nucleotide.

9. The single stranded oligonucleotide of claim 1, wherein each nucleotide of the oligonucleotide is a LNA nucleotide.

10. The single stranded oligonucleotide of claim 1, wherein the nucleotides of the oligonucleotide comprise alternating deoxyribonucleotides and 2'-fluoro-deoxyribonucleotides.

11. The single stranded oligonucleotide of claim 1, wherein the nucleotides of the oligonucleotide comprise alternating deoxyribonucleotides and 2'-O-methyl nucleotides.

12. The single stranded oligonucleotide of claim 1, wherein the nucleotides of the oligonucleotide comprise alternating deoxyribonucleotides and ENA nucleotide analogues.

13. The single stranded oligonucleotide of claim 1, wherein the nucleotides of the oligonucleotide comprise alternating deoxyribonucleotides and LNA nucleotides.

14. The single stranded oligonucleotide of claim 10, wherein the 5' nucleotide of the oligonucleotide is a deoxyribonucleotide.

15. The single stranded oligonucleotide of claim 1, wherein the nucleotides of the oligonucleotide comprise alternating LNA nucleotides and 2'-O-methyl nucleotides.

16. The single stranded oligonucleotide of claim 15, wherein the 5' nucleotide of the oligonucleotide is a LNA nucleotide.

17. The single stranded oligonucleotide of claim 1, wherein the nucleotides of the oligonucleotide comprise deoxyribonucleotides flanked by at least one LNA nucleotide on each of the 5' and 3' ends of the deoxyribonucleotides.

18. The single stranded oligonucleotide of claim 1, further comprising phosphorothioate internucleotide linkages between at least two nucleotides.

19. The single stranded oligonucleotide of claim 18, further comprising phosphorothioate internucleotide linkages between all nucleotides.

20. The single stranded oligonucleotide of claim 1, wherein the nucleotide at the 3' position of the oligonucleotide has a 3' hydroxyl group.

21. The single stranded oligonucleotide of claim 1, wherein the nucleotide at the 3' position of the oligonucleotide has a 3' thiophosphate.

22. The single stranded oligonucleotide of claim 1, further comprising a biotin moiety conjugated to the 5' nucleotide.

23. A single stranded oligonucleotide produced by a process comprising:
synthesizing a single stranded oligonucleotide that:
(a) comprises a region of complementarity that is complementary with at least 8 consecutive nucleotides of a PRC2-associated region of a human hemoglobin gene, wherein the PRC2-associated region is a region of the hemoglobin gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the hemoglobin gene compared to a control sequencing reaction of products of a control RNA-immunoprecipitation assay that employs a control antibody;

(b) is between 11 and 16 nucleotides in length and has at least one of:
  i) a sequence that is 5'X-Y-Z, wherein X is any nucleotide and wherein X is anchored at the 5' end of the oligonucleotide, Y is a nucleotide sequence of 6 nucleotides in length that is not a human seed sequence of a microRNA, and Z is a nucleotide sequence of 4 to 9 nucleotides in length;
  ii) a sequence that does not comprise three or more consecutive guanosine nucleotides;
  iii) a sequence that is complementary to a PRC2-associated region that encodes an RNA that forms a secondary structure comprising at least two single stranded loops; and/or
  iv) a sequence that has greater than 60% G-C content;
wherein, during the synthesis, at least one nucleotide incorporated into the oligonucleotide is a nucleotide analogue.

24. The single stranded oligonucleotide of claim 23, wherein the oligonucleotide has the sequence 5'X-Y-Z.

25. A composition comprising a single stranded oligonucleotide of claim 1 and a carrier.

26. A composition comprising a single stranded oligonucleotide of claim 1 in a buffered solution.

27. A composition of claim 26, wherein the oligonucleotide is conjugated to the carrier.

28. The composition of claim 27, wherein the carrier is a peptide.

29. The composition of claim 27, wherein the carrier is a steroid.

30. A pharmaceutical composition comprising a composition of claim 25 and a pharmaceutically acceptable carrier.

31. A kit comprising a container housing the composition of claim 25.

* * * * *